(12) United States Patent
Von Maltzahn et al.

(10) Patent No.: US 10,136,646 B2
(45) Date of Patent: Nov. 27, 2018

(54) AGRICULTURAL ENDOPHYTE-PLANT COMPOSITIONS, AND METHODS OF USE

(71) Applicant: SYMBIOTA, INC., Cambridge, MA (US)

(72) Inventors: Geoffrey Von Maltzahn, Boston, MA (US); Richard Bailey Flavell, Thousand Oaks, CA (US); Gerardo V. Toledo, Belmont, MA (US); Allison Jack, Arlington, MA (US); David Morris Johnston, Cambridge, MA (US); Slavica Djonovic, Malden, MA (US); Luis Miguel Marquez, Belmont, MA (US); Yves Alain Millet, Newtonville, MA (US); Craig Sadowski, Somerville, MA (US); Jeffrey Lyford, Hollis, NH (US); Alexander Naydich, Cambridge, MA (US)

(73) Assignee: Indigo Ag, Inc., Boston, MA (US)

( * ) Notice: Subject to any disclaimer, the term of this patent is extended or adjusted under 35 U.S.C. 154(b) by 0 days.

(21) Appl. No.: 14/916,514

(22) PCT Filed: Sep. 4, 2014

(86) PCT No.: PCT/US2014/054160
§ 371 (c)(1),
(2) Date: Mar. 3, 2016

(87) PCT Pub. No.: WO2015/035099
PCT Pub. Date: Mar. 12, 2015

(65) Prior Publication Data
US 2017/0020138 A1    Jan. 26, 2017

Related U.S. Application Data

(63) Continuation of application No. 14/316,469, filed on Jun. 26, 2014, now Pat. No. 9,113,636.

(60) Provisional application No. 61/959,861, filed on Sep. 4, 2013, provisional application No. 61/959,870, filed on Sep. 4, 2013, provisional application No. 61/959,871, filed on Sep. 4, 2013, provisional application No. 61/959,875, filed on Sep. 4, 2013.

(30) Foreign Application Priority Data

Jun. 26, 2014    (WO) ................ PCT/US2014/044427

(51) Int. Cl.
| | | |
|---|---|---|
| A01N 63/00 | (2006.01) | |
| A01N 63/02 | (2006.01) | |
| A01C 1/06 | (2006.01) | |
| G01N 33/50 | (2006.01) | |
| A01C 1/00 | (2006.01) | |

(52) U.S. Cl.
CPC ................ *A01N 63/00* (2013.01); *A01C 1/06* (2013.01); *A01N 63/02* (2013.01); *G01N 33/5097* (2013.01); *A01C 1/00* (2013.01)

(58) Field of Classification Search
None
See application file for complete search history.

(56) References Cited

U.S. PATENT DOCUMENTS

| | | | |
|---|---|---|---|
| 4,940,834 | A | 7/1990 | Hurley et al. |
| 5,041,290 | A | 8/1991 | Gindrat et al. |
| 5,113,619 | A | 5/1992 | Leps et al. |
| 5,229,291 | A | 7/1993 | Nielsen et al. |
| 5,292,507 | A | 3/1994 | Charley |
| 5,415,672 | A | 5/1995 | Fahey et al. |
| 5,730,973 | A | 3/1998 | Morales et al. |
| 5,919,447 | A | 7/1999 | Marrone et al. |
| 5,994,117 | A | 11/1999 | Bacon et al. |
| 6,072,107 | A | 6/2000 | Latch et al. |
| 6,077,505 | A | 6/2000 | Parke et al. |
| 6,337,431 | B1 | 1/2002 | Tricoli et al. |
| 6,495,133 | B1 | 12/2002 | Xue |
| 6,681,186 | B1 | 1/2004 | Denisov et al. |
| 6,689,880 | B2 | 2/2004 | Chen et al. |
| 6,823,623 | B2 | 11/2004 | Minato et al. |
| 7,037,879 | B2 | 5/2006 | Imada et al. |
| 7,084,331 | B2 | 8/2006 | Isawa et al. |
| 7,335,816 | B2 | 2/2008 | Kraus et al. |
| 7,341,868 | B2 | 3/2008 | Chopade et al. |
| 7,485,451 | B2 | 2/2009 | VanderGheynst et al. |

(Continued)

FOREIGN PATENT DOCUMENTS

| | | |
|---|---|---|
| CA | 1041788 | 11/1978 |
| CA | 1229497 | 11/1987 |

(Continued)

OTHER PUBLICATIONS

Johnson-Monje et al (2011) PLOSone 6(6):e20396, 1-22).*
Kuklinsky-Sobral et al (2004), 6(12), 1241-1251.i will mke.*
Mastretta et al (International Journal of Phytoremediation (2009).*
Navarro et al (Agron. Sustain. Dev. (2011) 31:173-190).*
Pillay et al (Can. J. Microbiology (1997) 43:354-361).*
Senthikumar et al (Current microbiology (2009), 58:288-293.*
Emerson et al (BioScience (2008) 58:925-936).*
Petti et al (Clinical infectious Disease (2007), 44:1108-1114).*
Ahmed et al. (Microbiologist Research 163(2008) 173-181.*

(Continued)

*Primary Examiner* — Medina A Ibrahim
(74) *Attorney, Agent, or Firm* — Fenwick & West LLP

(57) ABSTRACT

This application relates to methods and materials for providing a benefit to a seed or seedling of an agricultural plant (e.g., an agricultural grass plant or a *Gycine* plant), or the agricultural plant derived from the seed or seedling. For example, this application provides purified bacterial populations that include novel seed bacterial endophytes, and synthetic combinations of seeds and/or seedlings (e.g., cereal or soy seeds and/or cereal or soy seedlings) with heterologous seed-derived bacterial endophytes.

15 Claims, 13 Drawing Sheets
Specification includes a Sequence Listing.

(56) References Cited

U.S. PATENT DOCUMENTS

| | | |
|---|---|---|
| 7,555,990 B2 | 7/2009 | Beaujot |
| 7,632,985 B2 | 12/2009 | Malven et al. |
| 7,763,420 B2 | 7/2010 | Stritzker et al. |
| 7,906,313 B2 | 3/2011 | Henson et al. |
| 7,977,550 B2 | 7/2011 | West et al. |
| 8,143,045 B2 | 3/2012 | Miansnikov et al. |
| 8,455,198 B2 | 6/2013 | Gao et al. |
| 8,455,395 B2 | 6/2013 | Miller et al. |
| 8,465,963 B2 | 6/2013 | Rolston et al. |
| 8,728,459 B2 | 5/2014 | Isawa et al. |
| 8,975,489 B2 | 3/2015 | Craven |
| 9,113,636 B2 | 8/2015 | von Maltzahn et al. |
| 9,277,751 B2 | 3/2016 | Sword |
| 9,288,995 B2 | 3/2016 | von Maltzahn et al. |
| 9,295,263 B2 | 3/2016 | von Maltzahn et al. |
| 9,364,005 B2 | 6/2016 | Miller et al. |
| 9,408,394 B2 | 8/2016 | von Maltzahn et al. |
| 9,532,572 B2 | 1/2017 | von Maltzahn et al. |
| 9,532,573 B2 | 1/2017 | von Maltzahn et al. |
| 9,545,111 B2 | 1/2017 | Sword |
| 9,622,485 B2 * | 4/2017 | von Maltzahn ........ A01N 63/00 |
| 9,687,001 B2 | 6/2017 | Vujanovic et al. |
| 9,756,865 B2 | 9/2017 | Sword |
| 2005/0072047 A1 | 4/2005 | Conkling et al. |
| 2006/0046246 A1 | 3/2006 | Zeng et al. |
| 2007/0028318 A1 | 2/2007 | Livore et al. |
| 2007/0055456 A1 | 3/2007 | Raftery et al. |
| 2007/0142226 A1 | 6/2007 | Franco |
| 2007/0292953 A1 | 12/2007 | Mankin et al. |
| 2008/0229441 A1 | 9/2008 | Young et al. |
| 2008/0289060 A1 | 11/2008 | De Beuckeleer et al. |
| 2009/0155214 A1 | 6/2009 | Isawa et al. |
| 2010/0064392 A1 | 3/2010 | Yang et al. |
| 2010/0095396 A1 | 4/2010 | Voeste et al. |
| 2010/0205690 A1 | 8/2010 | Biasing et al. |
| 2010/0227357 A1 | 9/2010 | Redman et al. |
| 2011/0182862 A1 | 7/2011 | Green et al. |
| 2012/0108431 A1 | 5/2012 | Williams et al. |
| 2012/0131696 A1 | 5/2012 | Aayal et al. |
| 2012/0144533 A1 | 6/2012 | Craven |
| 2012/0178624 A1 | 7/2012 | Kaminskyj et al. |
| 2012/0324599 A1 | 12/2012 | Kerns et al. |
| 2013/0031673 A1 | 1/2013 | Grandlic et al. |
| 2013/0071425 A1 | 3/2013 | Vidal et al. |
| 2013/0079225 A1 | 3/2013 | Smith et al. |
| 2013/0150240 A1 | 6/2013 | Newman et al. |
| 2013/0233501 A1 | 9/2013 | Van Zyl et al. |
| 2014/0020136 A1 | 1/2014 | Van Der Wolf et al. |
| 2014/0109249 A1 | 4/2014 | Turner et al. |
| 2014/0115731 A1 | 4/2014 | Turner et al. |
| 2014/0147425 A1 | 5/2014 | Henn et al. |
| 2014/0342905 A1 | 11/2014 | Bullis et al. |
| 2015/0020239 A1 | 1/2015 | von Maltzahn et al. |
| 2015/0126365 A1 | 5/2015 | Sword |
| 2015/0230478 A1 | 8/2015 | Vujanovic et al. |
| 2015/0335029 A1 | 11/2015 | Mitter et al. |
| 2015/0366217 A1 | 12/2015 | Vujanovic et al. |
| 2015/0373993 A1 | 12/2015 | von Maltzahn et al. |
| 2016/0150796 A1 | 6/2016 | von Maltzahn et al. |
| 2016/0174570 A1 | 6/2016 | vujanovic et al. |
| 2016/0192662 A1 | 7/2016 | Sword |
| 2016/0205947 A1 | 7/2016 | Sword |
| 2016/0235074 A1 | 8/2016 | von Maltzahn et al. |
| 2016/0255844 A1 | 9/2016 | Mitter et al. |
| 2016/0286821 A1 | 10/2016 | Sword |
| 2016/0316760 A1 | 11/2016 | Ambrose et al. |
| 2016/0316763 A1 | 11/2016 | Sword |
| 2016/0330976 A1 | 11/2016 | Mitter et al. |
| 2016/0338360 A1 | 11/2016 | Mitter et al. |
| 2016/0366892 A1 | 12/2016 | Ambrose et al. |
| 2017/0164619 A1 | 6/2017 | von Maltzahn et al. |
| 2017/0164620 A1 | 6/2017 | von Maltzahn et al. |
| 2017/0215358 A1 | 8/2017 | Franco et al. |
| 2017/0223967 A1 | 8/2017 | Mitter et al. |

FOREIGN PATENT DOCUMENTS

| | | |
|---|---|---|
| CA | 2562175 | 1/2013 |
| CN | 1604732 | 4/2005 |
| CN | 101311262 A | 11/2008 |
| CN | 101570738 | 11/2009 |
| CN | 102168022 A | 8/2011 |
| CN | 102010835 B | 4/2012 |
| CN | 103642725 A | 3/2014 |
| EP | 0192342 | 8/1986 |
| EP | 0223662 | 5/1987 |
| EP | 0378000 | 7/1990 |
| EP | 0494802 | 7/1992 |
| EP | 0818135 | 1/1998 |
| EP | 1935245 | 6/2008 |
| EP | 2676536 | 12/2013 |
| JP | 2009/072168 | 4/2009 |
| KR | 20100114806 A | 10/2010 |
| WO | WO 1988/009114 | 1/1988 |
| WO | WO 1994/016076 | 7/1994 |
| WO | WO 2000/029607 | 5/2000 |
| WO | WO 2001/083818 | 11/2001 |
| WO | WO 2002/065836 | 8/2002 |
| WO | WO 2005/003328 | 1/2005 |
| WO | WO 2007/021200 | 2/2007 |
| WO | WO 2007/107000 | 9/2007 |
| WO | WO 2008/103422 | 8/2008 |
| WO | WO 2009/012480 A2 | 1/2009 |
| WO | WO 2009/126473 A1 | 10/2009 |
| WO | WO 2010109436 * | 9/2010 |
| WO | WO 2010/115156 | 10/2010 |
| WO | WO 2011/001127 | 1/2011 |
| WO | WO 2011/082455 | 7/2011 |
| WO | WO 2011/117351 | 9/2011 |
| WO | WO 20111127 * | 9/2011 |
| WO | WO 2012/034996 | 3/2012 |
| WO | WO 2013/016361 | 1/2013 |
| WO | WO 2013/029112 | 3/2013 |
| WO | WO 2013/090628 | 6/2013 |
| WO | WO 2013/122473 | 8/2013 |
| WO | WO 2013/177615 | 12/2013 |
| WO | WO 2013/190082 | 12/2013 |
| WO | WO 2014/046553 | 3/2014 |
| WO | WO 2014/082950 | 6/2014 |
| WO | WO 2014/121366 | 8/2014 |
| WO | WO 2014/206953 | 12/2014 |
| WO | WO 2014/210372 | 12/2014 |
| WO | WO 2015/035099 | 3/2015 |
| WO | WO 2015/069938 | 5/2015 |
| WO | WO 2015/100431 | 7/2015 |
| WO | WO 2015/100432 | 7/2015 |
| WO | WO 2015/200852 | 12/2015 |
| WO | WO 2015/200902 | 12/2015 |
| WO | WO 2016/109758 | 7/2016 |
| WO | WO 2016/179046 | 11/2016 |
| WO | WO 2016/179047 | 11/2016 |
| WO | WO 2016/200987 | 12/2016 |

OTHER PUBLICATIONS

Canadian Patent Office, Office Action, Canadian Patent Application No. CA 2,953,466, dated Dec. 11, 2017, 7 Pages.

Canadian Patent Office, Office Action, Canadian Patent Application No. CA 2,929,487, dated Dec. 7, 2017, 4 Pages.

Chinese Patent Office, 2nd Office Action for Chinese Patent Application No. CN 201480072142.7, dated Oct. 30, 2017, 13 Pages, (with English translation).

European Patent Office, Communication Pursuant to Article 94(3) EPC for European Patent Application No. 13874703.5, dated Jan. 5, 2018, 4 Pages.

European Patent Office, Supplementary European Search Report, European Patent Application No. EP 15809264.3, dated Dec. 4, 2017, 16 Pages.

European Patent Office, Communication Pursuant to Article 94(3) EPC for European Patent Application No. 15810847.2, dated Nov. 17, 2017, 17 Pages.

European Patent Office, Supplementary European Search Report,

(56) References Cited

OTHER PUBLICATIONS

European Patent Application No. EP 15812324.0, dated Nov. 2, 2017, 19 Pages.
Intellectual Property Australia, Examination Report No. 1 for Australian Patent Application No. AU 2017254880, dated Nov. 15, 2017, 2 Pages.
New Zealand Intellectual Property Office, First Examination Report for New Zealand Patent Application No. NZ 728483, dated Dec. 8, 2017, 2 Pages.
Russian Patent Office, Office Action for Russian Patent Application No. RU 2017127214, dated Nov. 22, 2017, 4 Pages, (with English translation).
Bensch, K., et al., "Species and ecological diversity within the Cladosporium cladosporioides complex (Davidiellaceae, Capnodiales)," Studies in Mycology, 2010, pp. 1-94, vol. 67.
Chagas, F., et al., "A Mixed Culture of Endophytic Fungi Increases Production of Antifungal Polyketides," J. Chem Ecol., Oct. 2013, pp. 1335-1342, vol. 39.
Misk, A., et al., "Biocontrol of chickpea root rot using endophytic actinobacteria", Biocontrol, vol. 56, No. 5, Mar. 12, 2011, pp. 811-822, XP036215297.
Sogonov, M.V., et al., "The hyphomycete *Teberdinia hygrophila* gen. nov., sp. nov. and related anamorphs of Pseudeurotium species," Mycologia, May 2005, pp. 695-709, vol. 97, No. 3.
Thakur, A., et al., "Detrimental effects of endophytic fungus *Nigrospora* sp. on survival and development of Spodoptera litura," Biocontrol Science and Technology, Feb. 1, 2012, pp. 151-161, vol. 22, No. 2.
Thakur, A., et al., "Enhanced Resistance to Spodoptera litura in Endophyte Infected Cauliflower Plants," Environmental Entomology, Apr. 1, 2013, pp. 240-246, vol. 42, No. 2.
Thakur, A., et al., "Suppression of Cellular Immune Response in Spodoptera litura (Lepidoptera: Noctuidae) Larvae by Endophytic Fungi Nigrospora oryzae and Cladosporium uredinicola,", Annals of the Entomological Society of America, May 1, 2014, pp. 674-679, vol. 107, No. 3.
Verkley, G., et al., "*Paraconiothyrium*, a new genus to accommodate the mycoparasite Coniothyrium minitans, anamorphs of Paraphaeosphaeria, and four new species," Studies in Mycology, 2004, pp. 323-335, vol. 50.
Visagie, C.M., et al., "Identification and nomenclature of the genus *Penicillium*," Studies in Mycology, Jun. 2014, pp. 343-371, vol. 78.
Zhao, J.H., et al., "Bioactive secondary metabolites from *Nigrospora* sp. LLGLM003, an endophytic fungus of the medicinal plant *Moringa oleifera* Lam." World Journal of Microbiology and Biotechnology, Kluwer Academic Publishers, Feb. 12, 2012, pp. 2107-2112, vol. 28, No. 5.
Garazzino, S., et al., "Osteomyelitis Caused by Enterobacter cancerogenus Infection following a Traumatic Injury: Case Report and Review of the Literature," J Clin Microbiol., Mar. 2005, vol. 43, No. 3, pp. 1459-1461.
Humann, J., et al., "Complete genome of the onion pathogen *Enterobacter cloacae* EcWSU1," Standard in Genomic Sciences, Dec. 31, 2011, vol. 5, No. 3, pp. 279-286.
Kumar, S., et al., "MEGA7: Molecular Evolutionary Genetics Analysis version 7.0 for bigger datasets," Molecular Biology and Evolution, Mar. 22, 2016, vol. 33, pp. 1870-1874.
Nishijima, K.A., et al., "Demonstrating Pathogenicity of Enterobacter cloacae on Macadamia and Identifying Associated Volatiles of Gray Kernel of Macadamia in Hawaii," Plant Disease, Oct. 2007, vol. 91, No. 10, pp. 1221-1228.
Ren, Y., et al., "Complete Genome Sequence of *Enterobacter cloacae* subsp. *cloacae* Type Strain ATCC 13047," J. Bacteriol. May 2010, vol. 192, No. 9, pp. 2463-2464.
Tamura, K., et al., "Estimation of the number of nucleotide substitutions in the control region of mitochondrial DNA in humans and chimpanzees," Molecular Biology and Evolution, 1993, vol. 10, No. 3, pp. 512-526.
Hoffman, M., et al., "Diverse Bacteria Inhabit Living Hyphae of Phylogenetically Diverse Fungal Endophytes," Applied and Environmental Microbiology, Jun. 2010, p. 4063-4075, vol. 76, No. 12.

Hoffman, M., et al., "Endohyphal Bacterium Enhances Production of Indole-3-Acetic Acid by a Foliar Fungal Endophyte," PLOS One, Sep. 24, 2013, pp. 1-8, vol. 8, Issue 9, e73132.
Jung, C., et al., "The Effects of Endohyphal Bacteria on Anti-Cancer and Anti-Malaria Metabolites of Endophytic Fungi," Honors Thesis, University of Arizona, May 2012, 15 Pages.
Kim, M., et al., "Towards a taxonomic coherence between average nucleotide identity and 16S rRNA gene sequence similarity for species demarcation of prokaryotes", Int J Systematic Evolutionary Microbial., 2014, vol. 64, pp. 346-351.
Yennamalli, R., et al., "Endoglucanases: insights into thermostability for biofuel applications", Biotech Biofuels, 2013, vol. 6, Issue 136, pp. 1-9.
PCT Invitation to Pay Additional Fees, PCT Application No. PCT/CA2013/000091, dated Mar. 27, 2013, 2 Pages.
PCT International Search Report and Written Opinion for PCT/CA2013/000091, dated Sep. 20, 2013, 17 Pages.
PCT International Search Report and Written Opinion for PCT/EP2013/062976, dated Dec. 22, 2014, 9 Pages.
PCT International Search Report, Application No. PCT/US2014/044427, dated Dec. 3, 2014, 9 Pages.
PCT International Search Report and Written Opinion, Application No. PCT/US2014/054160, dated Dec. 9, 2014, 21 Pages.
PCT Invitation to Pay Additional Fees, PCT Application No. PCT/US2014/064411, dated Feb. 5, 2015, 2 Pages.
PCT International Search Report and Written Opinion, International Application No. PCT/US2014/064411, dated Mar. 27, 2015, 15 Pages.
PCT Invitation to Pay Additional Fees, PCT Application No. PCT/US2014/072399, dated Apr. 14, 2015, 2 Pages.
PCT International Search Report and Written Opinion, International Application No. PCT/US2014/072399, dated Jun. 26, 2015, 22 Pages.
PCT Invitation to Pay Additional Fees, PCT Application No. PCT/US2014/072400, dated Apr. 16, 2015, 6 Pages.
PCT International Search Report and Written Opinion, Application No. PCT/US2014/072400, dated Jul. 8, 2015, 38 Pages.
PCT International Search Report and Written Opinion, Application No. PCT/AU2014/000360, dated Aug. 5, 2015, 12 Pages.
PCT Invitation to Pay Additional Fees, PCT Application No. PCT/US2015/038110, dated Sep. 22, 2015, 8 Pages.
PCT Invitation to Pay Additional Fees, PCT Application No. PCT/US2015/038187, dated Oct. 14, 2015, 5 Pages.
PCT International Search Report and Written Opinion, PCT Application No. PCT/US2015/038110, dated Dec. 11, 2015, 36 Pages.
PCT International Search Report and Written Opinion, PCT Application No. PCT/US2015/038187, dated Jan. 22, 2016, 36 Pages.
PCT Invitation to Pay Additional Fees, PCT Application No. PCT/US2015/068206, dated Apr. 12, 2016, 5 Pages.
PCT International Search Report and Written Opinion, PCT Application No. PCT/US2015/068206, dated Jun. 27, 2016, 20 Pages.
PCT International Search Report and Written Opinion, PCT Application No. PCT/US2016/030292, dated Aug. 12, 2016, 20 Pages.
PCT International Preliminary Report on Patentability, PCT Application No. PCT/US2016/030292, dated Aug. 2, 2017, 23 Pages.
PCT International Search Report and Written Opinion, PCT Application No. PCT/US2016/030293, dated Aug. 11, 2016, 23 Pages.
PCT International Search Report and Written Opinion, PCT Application No. PCT/US2016/036504, dated Nov. 4, 2016, 18 Pages.
PCT International Search Report and Written Opinion, PCT Application No. PCT/US2016/039191, dated Nov. 29, 2016, 20 Pages.
PCT International Search Report and Written Opinion, PCT Application No. PCT/US2016/068144, dated May 18, 2017, 30 Pages.
Canadian Patent Office, Office Action, Canadian Patent Application No. 2,916,678, dated Feb. 8, 2017, 8 Pages.
Canadian Patent Office, Office Action, Canadian Patent Application No. 2,935,218, dated Jun. 13, 2017, 5 Pages.
Chinese Patent Office, Office Action, Chinese Patent Application No. 201480072142.7, dated Apr. 25, 2017, 14 Pages. (with English translation).
European Patent Office, Supplementary Partial European Search Report, European Patent Application No. 13874703.5, dated Jun. 21, 2016, 3 Pages.

(56) References Cited

OTHER PUBLICATIONS

European Patent Office, Supplementary European Search Report, European Patent Application No. 13874703.5, dated Oct. 21, 2016, 16 Pages.
European Patent Office, Supplementary European Search Report, European Patent Application No. 14860187.5, dated May 24, 2017, 9 Pages.
European Patent Office, Supplementary European Search Report, European Patent Application No. 14874589.6, dated Jul. 11, 2017, 9 Pages.
European Patent Office, Examination Report, European Patent Application No. 14748326.7, dated Jul. 19, 2017, 4 Pages.
Intellectual Property Australia, Examination Report for Australian Patent Application No. 2016202480, dated Apr. 28, 2016, 2 Pages.
Intellectual Property Australia, Examination Report for Australian Patent Application No. 2014346664, dated Nov. 24, 2016, 3 Pages.
Intellectual Property Australia, Examination Report for Australian Patent Application No. 2014315191, dated Jul. 15, 2017, 6 Pages.
Intellectual Property Australia, Examination Report for Australian Patent Application No. 2015279600, dated Jul. 21, 2017, 7 Pages.
Intellectual Property Australia, Examination Report for Australian Patent Application No. 2015278238, dated Jul. 24, 2017, 3 Pages.
New Zealand Intellectual Property Office, First Examination Report, New Zealand Patent Application No. 715728, dated May 10, 2016, 4 Pages.
New Zealand Intellectual Property Office, First Examination Report, New Zealand Patent Application No. 715728, dated Dec. 5, 2016, 3 Pages.
New Zealand Intellectual Property Office, First Examination Report, New Zealand Patent Application No. 727449, dated Jun. 8, 2017, 7 Pages.
New Zealand Intellectual Property Office, First Examination Report, New Zealand Patent Application No. 726116, dated Jun. 29, 2017, 2 Pages.
New Zealand Intellectual Property Office, First Examination Report, New Zealand Patent Application No. 728495, dated Jul. 12, 2017, 5 Pages.
Russian Patent Office, Office Action for Russian Patent Application No. 2015137613, dated Jun. 7, 2017, 14 Pages. (with English translation).
Ukraine Patent Office, Office Action for Ukrainian Patent Application No. a201506515, dated May 19, 2017, 14 Pages. (with English translation).
Abarenkov, K., et al., "PlutoF-A Web Based Workbench for Ecological and Taxonomic Research, with an Online Implementation for Fungal ITS Sequences," Evol Bioinform Online, 2010, pp. 189-196, vol. 6.
Abarenkov, K., et al., "The UNITE Database for Molecular Identification of Fungi—Recent Updates and Future Perspectives," New Phytol., 2010, pp. 281-285, vol. 186.
Abdellatif, L., et al., "Endophytic hyphal compartmentalization is required for successful symbiotic Ascomycota association with root cells," Mycological Research, 2009, pp. 782-791, vol. 113.
Ahmad, F., et al., "Screening of Free-Living Rhizospheric Bacteria for Their Multiple Plant Growth Promoting Activities," Microbiol Res., 2008, pp. 173-181, vol. 163.
Amann, R., et al., "The Identification of Microorganisms by Fluorescence in Situ Hybridisation," Curr Opin Biotechnol., 2001, pp. 231-236, vol. 12.
Apel, K., et al., "Reactive Oxygen Species: Metabolism, Oxidative Stress, and Signal Transduction," Annu Rev Plant Biol., 2004, pp. 373-399, vol. 55.
Arendt, K. R., et al., "Isolation of endohyphal bacteria from foliar Ascomycota and in vitro establishment of their symbiotic associations," Appl. Environ. Microbiol., 2016, pp. 2943-2949, vol. 82, No. 10.
Ashrafuzzaman, M., et al., "Efficiency of plant growth-promoting rhizobacteria (PGPR) for the enhancement of rice growth," African Journal of Biotechnology, 2009, pp. 1247-1252, vol. 8, No. 7.

Bacon, C. W., et al., "Isolation, In Planta Detection, and Uses of Endophytic Bacteria for Plant Protection," Manual of Environmental Microbiology, 2007, pp. 638-647.
Baker, K. F., et al., "Dynamics of Seed Transmission of Plant Pathogens," Annu Rev Phytopathol., 1966, pp. 311-334, vol. 4.
Baltruschat, H., et al., "Salt tolerance of barley induced by the root endophyte Piriformospora indica is associated with a strong increase in antioxidants," New Phytologist., 2008, pp. 501-510, vol. 180.
Block, C. C., et al., "Seed Transmission of Pantoea stewartii in Field and Sweet Corn," Plant Disease, 1998, pp. 775-780, vol. 82.
Brinkmeyer, R., et al., "Uncultured Bacterium Clone ARKMP-100 16S Ribosomal RNA Gene, Partial Sequence," NCBI GenBank Accession No. AF468334, Submitted Jan. 14, 2002.
Brodie, E.L., et al., "Uncultured Bacterium Clone BANW722 16S Ribosomal RNA Gene, Partial Sequence," NCBI GenBank Accession No. DQ264636, Submitted Oct. 25, 2005.
Bulgarelli, D., et al., "Structure and Functions of the Bacterial Microbiota of Plants," Annu Rev Plant Biol., 2013, pp. 807-838, vol. 64.
Buttner, D., et al., "Regulation and secretion of Xanthomonas virulence factors," FEMS Microbiology Reviews, 2010, pp. 107-133, vol. 34, No. 2.
Caporaso, J.G., et al., "Ultra-High-Throughput Microbial Community Analysis on the Illumina HiSeq and MiSeq Platforms," ISME J., 2012, pp. 1621-1624, vol. 6.
Castillo, D., et al., "Fungal Entomopathogenic Endophytes: Negative Effects on Cotton Aphid Reproduction in Greenhouse and Field Conditions," Power Point Presentation dated Mar. 23, 2013.
Castillo, D., et al., "Fungal Endophytes: Plant Protective Agents Against Herbivores," Power Point Presentation dated Aug. 4, 2013.
Cavalier-Smith, T., "A Revised Six-Kingdom System of Life," Biol Rev Camb Philos Soc., 1998, pp. 203-266, vol. 73.
Cha, C., et al., "Production of Acyl-Homoserine Lactone Quorum-Sensing Signals by Gram-Negative Plant Associated Bacteria," Mol Plant Microbe Interact., 1998, pp. 1119-1129, vol. 11, No. 11.
Chernin, L. S., et al., "Chitinolytic Activity in Chromobacterium violaceum: Substrate Analysis and Regulation by Quorum Sensing," J Bacteriol., 1998, pp. 4435-4441, vol. 180, No. 17.
Clark, E. M., et al., "Improved Histochemical Techniques for the Detection of Acremonium coenophilum in Tall Fescue and Methods of in vitro Culture of the Fungus," J. Microbiol Methods, 1983, pp. 149-155, vol. 1.
Clay, K., "Effects of fungal endophytes on the seed and seedling biology of Lolium perenne and Festuca arundinacea," Oecologia, 1987, pp. 358-362, vol. 73.
Clough, S. J., et al., "Floral Dip: A Simplified Method for Agrobacterium-mediated Transformation of *Arabidopsis thaliana*," Plant J., 1998, pp. 735-743, vol. 16, No. 6.
Compant, S., et al., "Endophytes of Grapevines Flowers, Berries, and Seeds: Identification of Cultivable Bacteria, Comparison with Other Plant Parts, and Visualization of Niches of Colonization," Microbial Ecology, 2011, pp. 188-197, vol. 62.
Coombs, J. T., et al., "Isolation and Identification of Actinobacteria from Surface-Sterilized Wheat Roots," Applied and Environmental Microbiology, 2003, pp. 5603-5608, vol. 69, No. 9.
Conn, V. M., "Effect of Microbial Inoculants on the Indigenous Actinobacterial Endophyte Population in the Roots of Wheats as Determined by Terminal Restriction Fragment Length Polymorphism," Applied and Environmental Microbiology, 2004, pp. 6407-6413, vol. 70, No. 11.
Cottyn, B., et al., "Phenotypic and genetic diversity of rice seed-associated bacteria and their role in pathogenicity and biological control," Journal of Applied Microbiology, 2009, pp. 885-897, vol. 107.
Cox, C. D., "Deferration of Laboratory Media and Assays for Ferric and Ferrous Ions," Methods Enzymol., 1994, pp. 315-329, vol. 235.
Craine, J. M., et al., "Global Diversity of Drought Tolerance and Grassland Climate-Change Resilience," Nature Climate Change, 2013, pp. 63-67, vol. 3.
Dalal, J.M., et al., "Utilization of Endophytic Microbes for Induction of Systemic Resistance (ISR) in Soybean (Glycine max (L) Merril) Against Challenge Inoculation with R. solani," Journal of Applied Science and Research, 2014, pp. 70-84, vol. 2, No. 5.

(56) References Cited

OTHER PUBLICATIONS

Danhorn, T., et al., "Biofilm Formation by Plant-Associated Bacteria," Annu Rev Microbiol., 2007, pp. 401-422, vol. 61.
Daniels, R., et al., "Quorum Signal Molecules as Biosurfactants Affecting Swarming in Rhizobium etli," PNAS, 2006, pp. 14965-14970, vol. 103, No. 40.
Darsonval, A., et al., "Adhesion and Fitness in the Bean Phyllosphere and Transmission to Seed of *Xanthomonas fuscans* subsp. *fuscans*," Molecular Plant-Microbe Interactions, 2009, pp. 747-757, vol. 22, No. 6.
Darsonval, A., et al., "The Type III Secretion System of *Xanthomonas fuscans* subsp. *fuscans* is involved in the Phyllosphere Colonization Process and in Transmission to Seeds of Susceptible Beans," Applied and Envioronmental Mirobiology, 2008, pp. 2669-2678, vol. 74, No. 9.
De Freitas, J. R., et al., "Phosphate-Solubilizing Rhizobacteria Enhance the Growth and Yield but not Phosphorus Uptake of Canola (*Brassica napus* L.)," Biol Fertil Soils, 1997, pp. 358-364, vol. 24.
De Lima Favaro, L. C., et al., "Epicoccum nigrum P16, a Sugarcane Endophyte, Produces Antifungal Compounds and Induces Root Growth," PLoS One, 2012, pp. 1-10, vol. 7, No. 6.
De Melo Pereira, G. V., et al. "A Multiphasic Approach for the Identification of Endophytic Bacterial in Strawberry Fruit and their Potential for Plant Growth Promotion," Microbial Ecology, 2012, pp. 405-417, vol. 63, No. 2.
De Souza, J. J., et al., "Terpenoids from Endophytic Fungi," Molecules, 2011, pp. 10604-10618, vol. 16, No. 12.
Dennis, C., et al., "Antagonistic Properties of Species Groups of Trichoderma," Trans Brit Mycol Soc, 1971, pp. 25-39, vol. 57, No. 1.
Desiro, A., et al., "Detection of a novel intracellular microbiome hosted in arbuscular mycorrhizal fungi," ISME Journal, 2014, pp. 257-270, vol. 8.
Djordjevic, D., et al., "Microtiter Plate Assay for Assessment of Listeria monocytogenes Biofilm Formation," Annl Environ Microbiol., 2002, pp. 2950-2958, vol. 68, No. 6.
Don, R. H., et al., "Properties of Six Pesticide Degradation Plasmids Isolated From Alcaligenes Paradoxus and Alcaligenes eutrophus," J Bacteriol., 1981, pp. 681-686, vol. 145, No. 2.
Dunbar, J, et al., "Uncultured Bacterium Clone NT42a2_20488 16S Ribosomal RNA Gene, Partial Sequence," NCBI GenBank Accession No. JQ378705. Submitted Nov. 8, 2012.
Eberhard, A., et al., "Structural Identification of Autoinducer of Photobacterium fischeri Luciferase," Biochem., 1981, pp. 2444-2449, vol. 20.
Edgar, R. C., "Search and Clustering Orders of Magnitude Faster than BLAST," Bioinformatics, 2010, pp. 2460-2461, vol. 26, No. 19.
Edgar, R. C., "Uparse: Highly Accurate OTU Sequences From Microbial Amplicon Reads," Nat Methods, 2013, pp. 996-8, vol. 10, No. 10.
EK-Ramos, M. J., "Ecology, Distribution and Benefits of Fungal Endophytes Isolated from Cultivated Cotton (Gossypium hirsutum) in Texas," Power Point Presentation dated Nov. 7, 2012.
EK-Ramos, M. J., et al.. "Spatial and Temporal Variation in Fungal Endophyte Communities Isolated from Cultivated Cotton (*Gossypium hirsutum*)," PLoS One, 2013, vol. 8, No. 6, 13 Pages.
EK-Ramos, M. J., et al., "Spatial and Temporal Variation in Fungal Endophyte Communities Isolated from Cultivated Cotton (*Gossypium hirsutum*)," Power Point Presentation dated Jan. 7, 2013.
El-Shanshoury, A. R., "Growth Promotion of Wheat Seedlings by *Streptomyces atroolivaceus*," Journal of Agronomy and Crop Science, 1989, pp. 109-114, vol. 163.
Endre, G., et al., "A Receptor Kinase Gene Regulating Symbiotic Nodule Development," Nature, 2002, pp. 962-966, vol. 417.
Faria, D. C., et al., "Endophytic Bacteria Isolated from Orchid and Their Potential to Promote Plant Growth," World J Microbiol Biotechnol., 2013, pp. 217-221, vol. 29.

Ferrando, L., et al., "Molecular and Culture-Dependent Analyses Revealed Similarities in the Endophytic Bacterial Community Composition of Leaves from Three Rice (*Oryza sativa*) Varieties," FEMS Microbiol Ecol., 2012, pp. 696-708, vol. 80.
Fiehn, O., et al., "Metabolite Profiling for Plant Functional Genomics," Nature Biotechnol., 2000, pp. 1157-1161, vol. 8.
Fierer, N., et al., "Cross-Biome Metagenomic Analyses of Soil Microbial Communities and Their Functional Attributes," Proc Natl Acad Sci USA, 2012, pp. 21390-21395, vol. 109, No. 52.
Fincher, G. B., "Molecular and Cellular Biology Associated with Endosperm Mobilization in Germinating Cereal Grains," Annu Rev Plant Physiol Plant Mol Biol., 1989, pp. 305-46, vol. 40.
Fisher, P. J., et al., "Fungal saprobes and pathogens as endophytes of rice (*Oryza sativa* L.)," New Phytol., 1992, pp. 137-143, vol. 120.
Fisher, P. R., et al., "Isolation and Characterization of the Pesticide-Degrading Plasmid pJP1 from Alcaligenes paradoxus," J Bacteriol., 1978, pp. 798-804, vol. 135, No. 3.
Franco, C., et al., "Actinobacterial Endophytes for Improved Crop Performance," Australasian Plant Pathology, 2007, pp. 524-531, vol. 36.
Fulthorpe, R. R., et al., "Distantly Sampled Soils Carry Few Species in Common," ISME J., 2008, pp. 901-910, vol. 2.
Gantner, S., et al., "Novel Primers for 16S rRNA-based Archaeal Community Analyses in Environmental Samples," J Microbiol Methods, 2011, pp. 12-18, vol. 84.
Gao, Z., et al., "Quantitation of Major Human Cutaneous Bacterial and Fungal Populations," J Clin Microbiol., 2010, pp. 3575-3581, vol. 48, No. 10.
Gasser, I., et al., "Ecology and Characterization of Polyhydroxyalkanoate-Producing Microorganisms on and in Plants," FEMS Microbiol Ecol., 2010, pp. 142-150, vol. 70.
Gavrish, E, et al., "*Lentzea* sp. MS6 16S Ribosomal RNA Gene, Partial Sequence," NCBI GenBank Accession No. EF599958. Submitted May 9, 2007.
Gilmour, S. J., et al., "Overexpression of the *Arabidopsis* CBF3 Transcriptional Activator Mimics Multiple Biochemical Changes Associated with Cold Acclimation," Plant Physiol., 2000, pp. 1854-1865, vol. 124.
Giraldo, A., et al., "Phylogeny of Sarocladium (Hypocreales)," Persoonia, 2015, pp. 10-24, vol. 34.
Gitaitis, R., et al., "The Epidemiology and Management of Seedborne Bacterial Diseases," Annu Rev Phytopathol., 2007, pp. 371-397, vol. 45.
Grondona, I., et al., "Tusal®, a commercial biocontrol formulation based on Trichoderma," Bulletin OILB/SROP, 2004, pp. 285-288, vol. 27, No. 8.
Gu, O., et al., "*Glycomyces sambucus* sp. nov., an endophytic actinomycete islolated from the stem of Sambucus adnata Wall," International Journal of Systematic and Evolutionary Microbiology, 2007, pp. 1995-1998, vol. 57.
Haake, V., et al., "Transcription Factor CBF4 is a Regulator of Drought Adaptation in *Arabidopsis*," Plant Physiol., 2002, pp. 639-648, vol. 130.
Haas, D., et al., "R Factor Variants with Enhanced Sex Factor Activity in Pseudomonas aeruginosa," Mol Gen Genet., 1976, pp. 243-251, vol. 144.
Hallman, J., et al., "Bacterial Endophytes in Agricultural Crops," Canadian J Microbial., 1997, pp. 895-914, vol. 43.
Hanson, L.E., "Reduction of Verticillium Wilt Symptoms in Cotton Following Seed Treatment with Trichoderma virens," The Journal of Cotton Science, 2000, pp. 224-231, vol. 4, No. 4.
Hanson, L.E., "Reduction of Verticillium Wilt Symptoms in Cotton Following Seed Treatment with Trichoderma virens," Proceedings Beltwide Cotton Conferences, 2000, vol. 1. (Abstract).
Hardegree, S. P. et al., "Effect of Polyethylene Glycol Exclusion on the Water Potential of Solution-Saturated Filter Paper," Plant Physiol., 1990, pp. 462-466, vol. 92.
Hardoim, P. R., et al., "Assessment of Rice Root Endophytes and Their Potential for Plant Growth Promotion," In: Hardoim, P.R., Bacterial Endophytes of Rice—Their Diversity, Characteristics and Perspectives, Groningen, 2011, pp. 77-100.

(56) References Cited

OTHER PUBLICATIONS

Hardoim, P. R., et al., "Dynamics of Seed-Borne Rice Endophytes on Early Plant Growth Stages," PLoS ONE, 2012, vol. 7, No. 2, 13 Pages.

Harman, G.E., et al., "Symposium: biocontrol and biotechnological methods for controlling cotton pests," Proceedings of the Beltwide Cotton Production Research Conf., 1989, Memphis, Tennessee, USA, pp. 15-20. (Abstract).

Hepler, P. K., et al., "Polarized Cell Growth in Higher Plants," Annu Rev Cell Dev Biol., 2001, pp. 159-187, vol. 17.

Hiatt, E. E., et al., "Tall Fescue Endophyte Detection: Commerical Immunoblot Test Kit Compared with Microscopic Analysis," Crop Science, 1999, pp. 796-799, vol. 39.

Hibbett, D. S., et al., "A Higher-Level Phylogenetic Classification of the Fungi," Mycol Res., 2007, pp. 509-547, vol. 111.

Hill, N. S., et al., "Endophyte Survival during Seed Storage: Endophyte-Host Interactions and Heritability," Crop Sci., 2009, pp. 1425-1430, vol. 49.

Hill N. S., et al., "Endophyte Survival during Seed Storage: Endophyte-Host Interactions and Heritability," PowerPoint, Dept. Crop Soil Sciences, University of Georgia, Nov. 16, 2012, 3 Pages.

Hinton, D. M., et al., "Enterobacter cloacae is an endophytic symbiont of corn," Mycopathologia, 1995, pp. 117-125, vol. 129.

Howell, C.R., et al., "Induction of Terpenoid Synthesis in Cotton Roots and Control of Rhizoctonia solani by Seed Treatment with Trichoderma virens," Phytopathology, 2000, pp. 248-252, vol. 90, No. 3.

Hubbard, M., et al., "Fungal Endophytes Improve Wheat Seed Germination Under Heat and Drought Stress," Botany, 2012, pp. 137-149, vol. 90.

Hung, P.Q., et al., "Isolation and Characterization of Endophytic Bacteria in Soybean (*Glycine* sp.)," Omonrice, 2004, pp. 92-101, vol. 12.

Idris, A., et al., "Efficacy of Rhizobacteria for Growth Promotion in Sorghum Under Greenhouse Conditions and Selected Modes of Action Studies," J Agr Sci., 2009, pp. 17-30, vol. 147.

Ikeda, S., et al., "The Genotype of the Calcium/Calmodulin-Dependent Protein Kinase Gene (CCaMK) Determines Bacterial Community Diversity in Rice Roots Under Paddy and Upland Field Conditions," Applied and Environmental Microbiology, 2011, pp. 4399-4405, vol. 77, No. 13.

Imoto, K., et al., "Comprehensive Approach to Genes Involved in Cell Wall Modifications in *Arabidopsis thaliana*," Plant Mol Biol., 2005, pp. 177-192, vol. 58.

Jalgaonwala, R., et al., "A Review on Microbial Endophytes from Plants: A Treasure Search for Biologically Active Metabolites," Global Journal of Research on Medicinal Plants & Indigenous Medicine, 2014, pp. 263-277, vol. 3, No. 6.

Janda, J. M., et al., "16S rRNA Gene Sequencing for Bacterial Identification in the Diagnostic Laboratory: Pluses, Perils, and Pitfalls," Journal of Clinical Microbiology, 2007, pp. 2761-2764, vol. 45, No. 9.

Johnston-Monje, D., et al., "Plant and Endophyte Relationships: Nutrient Management," Comprehensive Biotechnol., 2011, pp. 713-727, vol. 4.

Johnston-Monje, D., "Microbial Ecology of Endophytic Bacteria in Zea Species as Influenced by Plant Genotype, Seed Origin, and Soil Environment," Thesis, University of Guelph, 2011, 230 Pages.

Jones, K.L., "Fresh Isolates of Actinomycetes in which the Presence of Sporogenous Aerial Mycelia is a Fluctuating Characteristic," J Bacteriol., 1949, pp. 141-145, vol. 57, No. 2.

Kaga, H., et al., "Rice Seeds as Sources of Endophytic Bacteria," Microbes Environ., 2009, pp. 154-162, vol. 24, No. 2.

Kalns, L., et al., "The Effects of Cotton Fungal Endophytes in the Field on Arthropod Community Structure," Power Point Presentation dated Jan. 7, 2013.

Kang, B. H., et al., "Members of the *Arabidopsis* Dynamin-Like Gene Family, ADL1, are Essential for Plant Cytokinesis and Polarized Cell Growth," Plant Cell, 2003, pp. 899-913, vol. 15.

Kasana, R. C., et al., "A Rapid and Easy Method for the Detection of Microbial Cellulases on Agar Plates Using Gram's Iodine," Curr Microbial., 2008, pp. 503-507, vol. 57.

Khan, A.L., et al., "Salinity Stress Resistance Offered by Endophytic Fungal Interaction Between Penicillium minioluteum LHL09 and *Glycine max*. L," J. Microbiol. Biotechnol., 2011, pp. 893-902, vol. 21, No. 9.

Kruger, M., et al., "DNA-Based Species Level Detection of Glomeromycota: One PCR Primer Set for All Arbuscular Mycorrhizal Fungi," New Phvtol., 2009, pp. 212-223, vol. 183.

Kuklinsky-Sobral, J., et al., "Isolation and Characterization of Endophytic Bacteria from Soybean (*Glycine max*) Grown in Soil Treated with Glyphosate Herbicide," Plant and Soil, 2005, pp. 91-99, vol. 273.

Lanver, D., et al., "Sho1 and Msb2-Related Proteins Regulate Appressorium Development in the Smut Fungus Ustilago aydis," Plant Cell, 2010, pp. 2085-2101, vol. 22.

Laus, M. C., et al., "Role of Cellulose Fibrils and Exopolysaccharides of Rhizobium leguminosarum in Attachment to and Infection of Vicia sativa Root Hairs," Mol Plant Microbe Interact., 2005, pp. 533-538, vol. 18, No. 6.

Le, X.H., et al., "Effects of endophytic Streptomyces on the lucerne (*Medicago sativa* L.) symbiosis at different levels of nitrogen," 17th Australian Nitrogen Fixation Conference 2014 Proceedings, Sep. 29, 2014, ed. Gupta, V.V.S.R., Unkovich, M. and Kaiser, B. N., ASNF, University of Adelaide, pp. 66-67.

Le, X.H., et al., "Isolation and characterisation of endophytic actinobacteria and their effect on the early growth and nodulation of lucerne (*Medicago sativa* L.)," 17th Australian Nitrogen Fixation Conference 2014 Proceedings, Sep. 29, 2014, ed. Gupta, V.V.S.R., Unkovich, M. and Kaiser, B. N., ASNF, University of Adelaide, pp. 134-136.

Lehman, S.G., "Treat Cotton Seed," Review of Applied Mycology, 1945, 24, 369.

Lehman, S.G., "Treat Cotton Seed," Research and Farming III, Progr. Rept., 1945, 3, 5.

Leonard, C. A., et al., "Random Mutagenesis of the Aspergillus oryzae Genome Results in Fungal Antibacterial Activity," Int J Microbiol., 2013, vol. 2013, Article ID 901697, 6 Pages.

Li, H. M., et al., "Expression of a Novel Chitinase by the Fungal Endophyte in Poa ampla," Mycologia, 2004, pp. 526-536, vol. 96, No. 3.

Li, H., et al., "Endophytes and their role in phytoremediation," Fungal Diversity, 2012, pp. 11-18, vol. 54.

Li, Q., "Agrobacterium tumefaciens Strain TA-AT-10 16S Ribosomal RNA Gene, Partial Sequence: GenBank: KF673157.1," Submitted Sep. 17, 2013.

Liu, M., et al., "A Novel Screening Method for Isolating Exopolysaccharide-Deficient Mutants," Appl Environ Microbiol., 1998, pp. 4600-4602, vol. 64, No. 11.

Liu, Y., et al., "Investigation on Diversity and Population Succession Dynamics of Endophytic Bacteria from Seeds of Maize (*Zea mays* L., Nongda108) at Different Growth Stages," Ann Microbiol., 2013, pp. 71-79, vol. 63.

Liu, D., et al., "Osmotin Overexpression in Potato Delays Development of Disease Symptoms," Proc Natl Acad Sci USA, 1994, pp. 1888-1892, vol. 91.

Liu, Y., et al., "Study on Diversity of Endophytic Bacterial Communities in Seeds of Hybrid Maize and their Parental Lines," Arch Microbiol., 2012, pp. 1001-1012, vol. 194.

Long, H. H., et al., "The Structure of the Culturable Root Bacterial Endophyte Community of Nicotiana attenuata is Organized by Soil Composition and Host Plant Ethylene Production and Perception," New Phytol., 2010, pp. 554-567, vol. 185.

Lopez-Lopez, A., et al., "Phaseolus vulgaris Seed-Borne Endophytic Community with Novel Bacterial Species such as *Rhizobium endophyticum* sp. nov.," Systematic Appl Microbiol., 2010, pp. 322-327, vol. 33.

Lorck, H., "Production of Hydrocyanic Acid by Bacteria," Physiol Plant, 1948, pp. 142-146, vol. 1.

Lugtenberg, B., et al., "Plant-Growth-Promoting Rhizobacteria," Ann. Rev. Microbiol., 2009, pp. 541-556, vol. 63.

(56) References Cited

OTHER PUBLICATIONS

Lundberg, D. S., et al., "Defining the Core *Arabidopsis thaliana* Root Microbiome," Nature, 2012, pp. 86-90, vol. 488, No. 7409.

Lundberg, D. S., et al., "Practical Innovations for High-Throughput Amplicon Sequencing," Nat Methods, 2013, pp. 999-1002, vol. 10, No. 10.

Ma, Y., et al., "Plant Growth Promoting Rhizobacteria and Endophytes Accelerate Phytoremediation of Metalliferous Soils," Biotechnology Advances, 2011, pp. 248-258, vol. 29.

Madi, L. et al., "Aggregation in Azospirillum brasilense Cd: Conditions and Factors Involved in Cell-to-Cell Adhesion," Plant Soil, 1989, pp. 89-98, vol. 115.

Mannisto, M.K., et al., "Characterization of Psychrotolerant Heterotrophic Bacteria From Finnish Lapland," Svst Appl Microbiol., 2006, pp. 229-243, vol. 29.

Mano, H., et al., "Culturable Surface and Endophytic Bacterial Flora of the Maturing Seeds of Rice Plants (*Oryza sativa*) Cultivated in a Paddy Field," Microbes Environ., 2006, vol. 21, No. 2.

Manter, D. K., et al.. "Use of the ITS Primers, ITSIF and ITS4, to Characterize Fungal Abundance and Diversity in Mixed-Template Samples by qPCR and Length Heterogeneity Analysis," J Microbiol Methods, 2007, pp. 7-14, vol. 71.

Mao, W., et al., "Seed Treatment with a Fungal or a Bacterial Antagonist for Reducing Corn Damping-off Caused by Species of Pythium and Fusarium," Plant Disease, 1997, pp. 450-454, vol. 81, No. 5.

Marasco, R., et al., "A Drought Resistance-Promoting Microbiome is Selected by Root System Under Desert Farming," PLoS ONE, 2012, vol. 7, No. 10, 14 Pages.

Marquez, L. M., et al., "A Virus in a Fungus in a Plant: Three-Way Symbiosis Required for Thermal Tolerance," Science, 2007, pp. 513-515, vol. 315.

Mateos, P. F., et al., "Cell-Associated Pectinolytic and Cellulolytic Enzymes in Rhizobium leguminosarum biovar trifolii," Appl Environ Microbiol., 1992, pp. 816-1822, vol. 58, No. 6.

McDonald, D., et al., "An Improved Greengenes Taxonomy with Explicit Ranks for Ecological and Evolutionary Analyses of Bacteria and Archaea," ISME J., 2012, pp. 610-8, vol. 6.

McGuire, K.L., et al., "Digging the New York City Skyline: Soil Fungal Communities in Green Roofs and City Parks," PloS One, 2013, vol. 8, No. 3, 13 Pages.

Medina, P., et al., "Rapid Identification of Gelatin and Casein Hydrolysis Using TCA," J Microbiol Methods, 2007, pp. 391-393, vol. 69.

Mehnaz, S., et al., "Growth Promoting Effects of Corn (*Zea mays*) Bacterial Isolates Under Greenhouse and Field Conditions," Soil Biology and Biochemistry, 2010, pp. 1848-1856, vol. 42.

Mehnaz, S., et al., "Isolation and 16S rRNA sequence analysis of the beneficial bacteria from the rhizosphere of rice," Canada Journal of Microbiology, 2001, pp. 110-117, vol. 47, No. 2.

Mei, C., et al., "The Use of Beneficial Microbial Endophytes for Plant Biomass and Stress Tolerance Improvement," Recent Patents on Biotechnology, 2010, pp. 81-95, vol. 4.

Michel, B. E., et al., "The Osmotic Potential of Polyethylene Glycol 6000," Plant Physiol., 1973, pp. 914-916, vol. 51.

Moe, L. A., "Amino Acids in the Rhizosphere: From Plants to Microbes," American Journal of Botany, 2013, pp. 1692-1705, vol. 100, No. 9.

Mohiddin, F. A., et al., "Tolerance of Fungal and Bacterial Biocontrol Agents to Six Pesticides Commonly Used in the Control of Soil Borne Plant Pathogens," African Journal of Agricultural Research, 2013, pp. 5331-5334, vol. 8, No. 43.

Mousa, W. K., et al., "The Diversity of Anti-Microbial Secondary Metabolites Produced by Fungal Endophytes: An Interdisciplinary Perspective," Front Microbial., 2013, vol. 4, No. 65, 18 Pages.

Mundt, J.O., et al., "Bacteria Within Ovules and Seeds," Appl Environ Microbiol., 1976, pp. 694-698, vol. 32, No. 5.

Naik, B. S., et al., "Study on the diversity of endophytic communities from rice (*Oryza sativa* L.) and their antagonistic activities in vitro," Microbiological Research, 2009, pp. 290-296, vol. 164.

Naveed, M., "Maize Endophytes—Diversity, Functionality and Application Potential," University of Natural Resources and Life Sciences, 2013, pp. 1-266 and 81-87; Tables 1-3; Figure 2.

Nejad, P. et al., "Endophytic Bacteria Induce Growth Promotion and Wilt Disease Suppression in Oilseed Rape and Tomato, " Biological Control, 2000, pp. 208-215, vol. 18.

Neslon, E.B., "Microbial Dynamics and Interactions in the Spermosphere," Ann. Rev. Phytopathol., 2004, pp. 271-309, vol. 42.

Nikolcheva, L.G., et al., "Taxon-Specific Fungal Primers Reveal Unexpectedly High Diversity During Leaf Decomposition in a Stream," Mycological Progress, 2004, pp. 41-49, vol. 3, No. 1.

Nimnoi, P., et al., "Co-Inoculation of Soybean (Glycin Max) with Actinomycetes and Bradyrhizobium Japonicum Enhances Plant Growth, Nitrogenase Activity and Plant Nutrition," Journal of Plant Nutrition, 2014, pp. 432-446, vol. 37.

Normander, B., et al., "Bacterial Origin and Community Composition in the Barley Phytosphere as a Function of Habitat and Presowing Conditions," Appl Environ Microbiol., Oct. 2000, pp. 4372-4377, vol. 66, No. 10.

Okunishi, S., et al., "Bacterial Flora of Endophytes in the Maturing Seeds of Cultivated Rice (*Oryza sativa*)," Microbes and Environment, 2005, pp. 168-177, vol. 20, No. 3.

Orole, O. O., et al., "Bacterial and fungal endophytes associated with grains and roots of maize," Journal of Ecology and the Natural Enviornment, 2011, pp. 298-303, vol. 3, No. 9.

Partida-Martinez, L.P., et al., "The Microbe-Free Plant: Fact or Artifact?" Front Plant Sci., 2011, vol. 2, No. 100, 16 Pages.

Pearson, W.R., et al., "Rapid and Sensitive Sequence Comparison With FASTP and FASTA," Methods Enzymol., 2011, pp. 63-98, vol. 183.

Pedraza, R. O., et al., "Azospirillum inoculation and nitrogen fertilization effect on grain yield and on the diversity of endophytic bacteria in the phyllosphere of rice rainfed crop," European Journal of Soil Biology, 2009, pp. 36-43, vol. 45.

Perez-Fernandez, M. A., et al., "Simulation of Germination of Pioneer Species Along an Experimental Drought Gradient," J Environ Biol., 2006, pp. 669-685, vol. 27, No. 4.

Perez-Miranda, S., et al., "O-CAS, A Fast and Universal Method for Siderophore Detection," J Microbiol Methods, 2007, pp. 127-131, vol. 70.

Phalip, V., et al., "A Method for Screening Diacetyl and Acetoin-Producing Bacteria on Agar Plates," J Basic Microbiol., 1994, pp. 277-280, vol. 34.

Philippot, L., et al., "Going Back to the Roots: The Microbial Ecology of the Rhizosphere," Nat Rev Microbiol., Nov. 2013, pp. 789-799, vol. 11.

Philrice Batac, Philippine Rice R&D Highlights, 2012, Area-Based R&D Projects, [online][Retrieved Aug. 11, 2016] Retrieved from the Internet <URL:http://www.philrice.gov.ph/2012-rd-highlights/>.

Powell, W. A., et al., "Evidence of Endophytic Beauveria Bassiana in Seed-Treated Tomato Plants Acting as a Systemic Entomopathogen to Larval Helicoverpa zea (Lepidoptera: Noctuidae)," J. Entomol. Sci., 2009, pp. 391-396, vol. 44, No. 4.

Quadt-Hallmann, A., et al., "Bacterial Endophytes in Cotton: Mechanisms of Entering the Plant," Can J Microbiol., 1997, pp. 577-582, vol. 43.

R Core Team, "R: A Language and Environment for Statistical Computing," R Foundation for Statistical Computing, Vienna, Austria, May 2013, ISBN: 3-900051-07-0. Available online at http://www.R-25project.org/, 3604 Pages.

Rasmussen, S., et al., "Grass-endophyte interactions: a note on the role of monosaccharide transport in the Neotyphodium lolii-Lolium perenne symbiosis," New Phytologist, 2012, pp. 7-12, vol. 196.

Ravel, C., et al., "Beneficial effects of Neotyphodium lolii on the growth and the water status in perennial ryegrass cultivated under nitrogen deficiency or drought stress," Agronomie, 1997, pp. 173-181, vol. 17.

Redman, R. S., et al., "Thermotolerance Generated by Plant/Fungal Symbiosis," Science, Nov. 2002, vol. 298, 1 Page (with 4 pages of supplemental material).

(56) References Cited

OTHER PUBLICATIONS

Reiter, B., et al., "Response of Endophytic Bacterial Communities in Potato Plants to Infection with *Erwinia carotovora* subsp. *atroseptica*," Appl Environ Microbiol., 2001, pp. 2261-2268, vol. 68, No. 5.

Rodriguez, H., et al., "Expression of a Mineral Phosphate Solubilizing Gene From Erwinia herbicola in Two Rhizobacterial Strains," J Biotechnol., 2001, pp. 155-161, vol. 84.

Rodriguez, R.J., et al., "Stress Tolerance in Plants via Habitat-Adapted Symbiosis," ISME J., 2008, pp. 404-416, vol. 2.

Rodriguez-Navarro, D., et al., "Soybean Interactions with Soil Microbes, Agronomical and Molecular Aspects," Agronomy for Sustainable Development, 2011, pp. 173-190, vol. 31, No. 1.

Roessner, U., et al., "Metabolic Profiling Allows Comprehensive Phenotyping of Genetically or Environmentally Modified Plant Systems," Plant Cell, 2001,pp. 11-29, vol. 13.

Rosado, A. S., et al., "Phenotypic and Genetic Diversity of Paenibacillus azotofixans Strains Isolated from the Rhizoplane or Rhizosphere Soil of Different Grasses," J App Microbiol., 1998, pp. 216-226, vol. 84.

Rosenblueth, A., et al., "Seed Bacterial Endophytes: Common Genera, Seed-to-Seed Variability and Their Possible Role in Plants," Acta Hort., 2012, pp. 39-48, vol. 938.

Rosenblueth, M., et al., "Bacterial Endophytes and Their Interactions With Host," Molecular Plant-Microbe Interactions, 2006, pp. 827-837, vol. 19, No. 8.

Ross, P.L., et al., "Multiplexed Protein Quantitation in *Saccharomyces cerevisiae* Using Amine-Reactive Isobaric Tagging Reagents," Mol Cell Proteomics, 2004, pp. 1154-1169, vol. 3, No. 12.

Saleem, M., et al., "Perspective of Plant Growth Promoting Rhizobacteria (PGPR) Containing ACC Deaminase in Stress Agriculture," J Ind Microbiol Biotechnol., Oct. 2007, pp. 635-648, vol. 34.

Samac, D.A., et al., "Recent Advances in Legume-Microbe Interactions: Recognition, Defense Response, and Symbiosis from a Genomic Perspective," Plant Physiol., 2007, pp. 582-587, vol. 144.

Sardi, P., et al., "Isolation of Endophytic *Streptomyces* Strains from Surface Sterilized Roots," Applied and Environmental Microbiology, 1992, pp. 2691-2693, vol. 58, No. 8.

Sarwar, M., et al., "Tryptophan Dependent Biosynthesis of Auxins in Soil," Plant Soil, 1992, pp. 207-215, vol. 147.

Schmieder, R., et al., "Quality Control and Preprocessing of Metagenomic Datasets," Bioinformatics, 2011, pp. 863-864, vol. 27, No. 6.

Schoch, C. L., et al., "Nuclear Ribosomal Internal Transcribed Spacer (ITS) Region as a Universal DNA Barcode Marker for Fungi," Proc Natl Acad Sci USA, 2012, pp. 6241-6246, vol. 109, No. 16.

Schwyn, B. et al., "Universal Chemical Assay for the Detection and Determination of Siderophores," Analytical Biochemistry, 1987, pp. 47-56, vol. 160.

Sessitsch, A., et al., "*Burkholderia phytofirmans* sp. Nov., a novel plant-associated bacterium with plant-beneficial properties," International Journal of Systematic and Evoluntary Microbiology, 2005, pp. 1187-1192, vol. 55.

Shapiro-Ilan, D.I., et al., "The Potential for Enhanced Fungicide Resistance in Beauveria Bassiana Through Strain Discovery and Artificial Selection," Journal of Invertebrate Pathology, 2002, pp. 86-93, vol. 81.

Shankar, M., et al.,"Root colonization of a rice growth promoting strain of Enterobacter cloacae," Journal of Basic Microbiology, 2011, pp. 523-530, vol. 51.

Singh, A. K., et al., "*Uncultured Actinomyces* sp. Clone Emlact 80 IV (New) 16S Ribosomal RNA Gene, Partial Sequence," NCBI GenBank Accession No. JQ285908. Submitted Dec. 13, 2011.

Soares, M. M. C. N., et al., "Screening of Bacterial Strains for Pectinolytic Activity: Characterization of the Polygalacturonase Produced by *Bacillus* SP," Revista de Microbiolgia, 1999, pp. 299-303, vol. 30.

Soe, K.M., et al., "Effects of endophytic actinomycetes and Bradyrhizobium japonicum strains on growth, nodulation, nitrogen fixation and seed weight of different soybean varieties," Soil Science and Plant Nutrition, 2012, pp. 319-325, vol. 58, No. 3.

Soe, K.M., et al., "Low-Density Co-Inoculation of Myanmar Bradyrhizobium yuanmingense MAS34 and *Streptomyces griseoflavus* P4 to Enhance Symbiosis and Seed Yield in Soybean Varieties," American Journal of Plant Sciences, 2013, pp. 1879-1892, vol. 4.

Song, M., et al., "Effects of Neotyphodium Endophyte on Germination of Hordeum brevisubulatum under Temperature and Water Stress Conditions," Acta Agrestia Sinica, 2010, pp. 834-837, vol. 18, No. 6. (English Abstract).

Souleimanov, A., et al., "The Major Nod Factor of Bradyrhizobium japonicum Promotes Early Growth of Soybean and Corn," J. Exp. Bot., 2002, pp. 1929-1934, vol. 53, No. 376.

Spiekermann, P., et al., "A Sensitive, Viable-Colony Staining Method Using Nile Red for Direct Screening of Bacteria that Accumulate Polyhydroxyalkanoic Acids and Other Lipid Storage Compounds," Arch Microbiol., 1999, pp. 73-80, vol. 171.

Staudt, A. K., et al., "Variations in Exopolysaccharide Production by Rhizobium tropici," Arch Microbiol., 2012, pp. 197-206, vol. 194.

Strobel, G. A., "Endophytes as Sources of Bioactive Products," Microbes and Infection, 2003, pp. 535-544, vol. 5.

Sturz, A. V., et al., "Weeds as a Source of Plant Growth Promoting Rhizobacteria in Agricultural Soils," Can J Microbiol., 2001, pp. 1013-1024, vol. 47, No. 11.

Surette, M. A., et al. "Bacterial Endophytes in Processing Carrots (*Daucus carota* L. var. *sativus*): Their Localization, Population Density, Biodiversity and Their Effects on Plant Growth," Plant and Soil, 2003, pp. 381-390, vol. 253, No. 2.

Suto, M., et al., "Endophytes as Producers of Xylanase," J Biosci Bioeng., 2002, pp. 88-90, vol. 93, No. 1.

Sword, G., "Manipulating Fungal Endophytes to Protect Plants from Insects and Nematodes," Power Point Presentation dated Aug. 7, 2013.

Sword, G., et al., "Manipulating Fungal Endophytes for the Protection of Cotton in the Field," Power Point Presentation dated Jan. 7, 2013.

Sword, G., et al., "Field Trials of Potentially Beneficial Fungal Endophytes in Cotton," Power Point Presentation dated Jan. 7, 2013.

Sword, G., "Fungal Endophytes to Protect Cotton from Insects and Nematodes," Power Point Presentation dated Dec. 7, 2012.

Sword, G., "Natural Enemies—The Forgotten Basis of IPM?," Power Point Presentation dated Sep. 6, 2013.

Taghavi, S., et al., "Genome Survey and Characterization of Endophytic Bacteria Exhibiting a Beneficial Effect on Growth and Development of Poplar Trees," Applied and Environmental Microbiology, 2009, pp. 748-757, vol. 75, No. 3.

Taylor, A. G., et al., "Concepts and Technologies of Selected Seed Treatments," Annu. Rev. Phytopathol., 1990, pp. 321-339, vol. 28.

Teather, R. M., et al., "Use of Congo Red-Polysaccharide Interactions in Enumeration and Characterization of Cellulolytic Bacteria from the Bovine Rumen," Appl Environ Microbiol., 1982, pp. 777-780, vol. 43, No. 4.

Theis, K. R., et al., "Uncultured Bacterium Clone GM2GI8201A64RC 16S Ribosomal RNA Gene, Partial Sequence," NCBI GenBank Accession No. JX051943, Submitted May 14, 2012.

Thomas, L., et al., "Development of Resistance to Chlorhexidine Diacetate in Pseudomonas aeruginosa and the Effect of a "Residual" Concentration," J Hosp Infect., 2000, pp. 297-303, vol. 46.

Thomashow, M. F., "So What's New in the Field of Plant Cold Acclimation? Lots!," Plant Physiol., 2001, pp. 89-93, vol. 125.

Tokala, R. T., et al., "Novel Plant-Microbe Rhizosphere Interaction Involving *Streptomyces Lydicus* WYEC108 and the Pea Plant (*Pisum sativum*)," Applied and Environmental Microbiology, May 2002, pp. 2161-2171, vol. 68, No. 5.

Trichoderma definition, 2016, [online] [Retrieved on Sep. 16, 2016,] Retrieved from the Internet <URL:https://en.wikipedia.org/wiki/Trichoderma>.

Trotel-Aziz, P., et al., "Characterization of New Bacterial Biocontrol Agents *Acinetobacter, Bacillus, Pantoea* and *Pseudomonas* spp.

(56) References Cited

OTHER PUBLICATIONS

Mediating Grapevine Resistance Against Botrytis cinerea," Environmental and Experimental Botany, 2008, pp. 21-32, vol. 64.
Truyens, S., et al., "Changes in the Population of Seed Bacteria of Transgenerationally Cd-Exposed *Arabidopsis thaliana*," Plant Biol., 2013, pp. 971-981, vol. 15.
Usadel, B., et al., "The Plant Transcriptome-From Integrating Observations to Models," Front Plant Sci., 2013, pp. 1-3, vol. 4., Article 48, 3 Pages.
Vacheron, J., et al., "Plant Growth-Promoting Rhizobacteria and Root System Functioning," Frontiers Plant Sci., 2013, vol. 4, Article 356, 19 Pages.
Valencia, C. U., et al., "Endophytic Establishment as an Unintended Consequence of Biocontrol with Fungal Entomopathogens," Power Point Presentation dated Jan. 7, 2013.
Van Der Lelie, D., et al., "Poplar and its Bacterial Endophytes: Coexistence and Harmony," Critical Rev Plant Sci., 2009, pp. 346-358, vol. 28.
Vining, K., et al., "Methylome Reorganization During in vitro Dedifferentiation and Regeneration of Populus trichocarpa," BMC Plant Biol., 2013, vol. 13, No. 92, 15 Pages.
Viruel, E., et al., "Pseudomonas thiveralensis Strain IEHa 16S Ribosomal RNA Fene, Partial Sequence," NCBI GenBank Accession No. GQ169380.1, Submitted May 15, 2009.
Waller, F., et al., "The Endophytic Fungus Piriformospora indica Reprograms Barley to Salt-Stress Tolerance, Disease Resistance, and Higher Yield," PNAS, 2005, pp. 13386-13391, vol. 102, No. 38.
Wang, B., et al., "Fungal endophytes of native Gossypium species in Australia," Mycological Research, 2007, pp. 347-354, vol. 111, No. 3.
Wang, K., et al., "Monitoring in Planta Bacterial Infection at Both Cellular and Whole-Plant Levels Using the Green Fluorescent Protein Variant GFPuv," New Phytol., 2007, pp. 212-223, vol. 174.
Wang, Q., et al., "Naive Bayesian Classifier for Rapid Assignment of rRNA Sequences into the New Bacterial Taxonomy," Appl. Environ. Microbial., 2007, pp. 5261-5267, vol. 73, No. 16.
Waqas, M., et al., "Endophytic Fungi Produce Gibberellins and Indoleacetic Acid and Promotes Host-Plant Growth during Stress," Molecules, 2012, pp. 10754-10773, vol. 17.
Weaver, P.F., et al., "Characterization of Rhodopseudomonas capsulata," Arch Microbiol., 1975, pp. 207-216, vol. 105.
Weindling, R., "Relation of dosage to control of cotton seedling diseases by seed treatment," Plant Disease Reporter, 1943, 27, 68-70.
Welty, R.E., et al., "Influence of Moisture Content, Temperature, and Length of Storage on Seed Germination and Survival of Endophytic Fungi in Seeds of Tall Fescue and Perennial Ryegrass," Phytopathyol., 1987, pp. 893-900, vol. 77, No. 6.
White, J. F., et al., "A Proposed Mechanism for Nitrogen Acquisition by Grass Seedlings Through Oxidation of Symbiotic Bacteria," Symbiosis, 2012, pp. 161-171, vol. 57.
Wiegand, I., et al., "Agar and Broth Dilution Methods to Determine the Minimal Inhibitory Concentration (MIC) of Antimicrobial Substances," Nature Protocols, 2008, pp. 163-175, vol. 3, No. 2.
Xu, M., et al., "Bacterial Community Compositions of Tomato (*Lycopersicum esculentum* Mill.) Seeds and Plant Growth Promoting Activity of ACC Deaminase Producing Bacillus subtilis (HYT-12-1) on Tomato Seedlings," World J Microbiol Biotechnol., 2014, pp. 835-845, vol. 30.
Xu, Y., et al., "Biosynthesis of the Cyclooligomer Despipeptide bassianolide, an Insecticidal Virulence Factor of Beauveria bassiana," Fungal Genetics and Biology, 2009, pp. 353-364, vol. 46.
Xue, Q.Y., et al., "Evaluation of the Strains of Acinetobacter and Enterobacter as potential Biocontrol Agents Against Ralstonia Wilt of Tomato," Biological Control, 2009, vol. 48, pp. 252-258.
Yandigeri, M. S., et al., "Drought-tolerant endophytic actinobactena promote growth of wheat (Triticum aestivum) under water stress conditions," Plant Growth Regulation, 2012, pp. 411-420, vol. 68.
Yezerski, A., et al., "The Effects of the Presence of Stored Product Pests on the Microfauna of a Flour Community," Journal of Applied Microbiology, 2005, pp. 507-515, vol. 98.
You, Y., et al., "Analysis of Genomic Diversity of Endophytic Fungal Strains Isolated from the Roots of Suaeda japonica and S. maritima for the Restoration of Ecosystems in Buan Salt Marsh," Korean Journal of Microbiology and Biotechnology, 2012, pp. 287-295, vol. 40, No. 4. (with English Abstract).
Zhou, W., et al., "Effects of the Fungal Endophyte *Paecilomyces* sp. in Cotton on the Roo-Knot Nematode Meloidogyne incognita," poster dated Jan. 7, 2013.
Zimmerman, N.B., et al., "Fungal Endophyte Communities Reflect Environmental Structuring Across a Hawaiian Landscape," Proc Natl Acad Sci USA, 2012, pp. 13022-13027, vol. 109, No. 32.
Zuccaro, A., et al., "Endophytic Life Strategies Decoded by Genome and Transcriptome Analyses of the Mutualistic Root Symbiont Piriformospora indica," PLOS Pathogens, 2011, vol. 7, No. 10, e1002290.
Zuniga, A., et al., "Quorum Sensing and Indole-3-Acetic Acid Degradation Play a Role in Colonization and Plant Growth Promotion of *Arabidopsis thaliana* by Burkholderia phytofirmans PsJN," Mol Plant Microbe Interact., 2013, pp. 546-553, vol. 26, No. 5.
Canadian Patent Office, Office Action, Canadian Patent Application No. CA 2,953,697, dated Oct. 12, 2017, 6 Pages.
Canadian Patent Office, Office Action, Canadian Patent Application No. CA 2,952,057, dated Oct. 12, 2017, 4 Pages.
European Patent Office, Examination Report for European Patent Application No. EP 14777213.1, dated Oct. 20, 2017, 12 Pages.
New Zealand Intellectual Property Office, First Examination Report, New Zealand Patent Application No. 726116, dated Sep. 26, 2017, 5 Pages.
Abdou, R., et al., "Botryorhodines A-D, antifungal and cytotoxic depsidones from Botryosphaeria rhodina, an endophyte of the medicinal plant *Bidens pilosa*," Phytochemistry, 2010, vol. 71, pp. 110-116.
Adhikari, M., et al., "A New Record of Pseudeurotium bakeri from Crop Field Soil in Korea," The Korean Journal of Mycology, 2016, pp. 145-149, vol. 44.
Alvarez-Perez, S., et al., "Zooming-in on floral nectar: a first exploration of nectar-associated bacteria in wild plant communities," FEMS Microbiol. Ecol., 2012, vol. 80, No. 3, pp. 591-602.
Clarridge, J., "Impact of 16S rRNA Gene Sequence Analysis for Identification of Bacteria on Clinical Microbiology and Infectious Diseases," Clinical Microbiology Reviews, Oct. 2004, pp. 840-862, vol. 17, No. 4.
GenEmbl Database, GenEmbl Record No. KF673660, Sandberg, et al., "Fungal endophytes of aquatic macrophytes: diverse host-generalists characterized by tissue preferences and geographic structure," 2013, 35 Pages.
GenEmbl Database, GenEmbl Record No. KP991588, Huang, et al., "Pervasive effects of wildfire on foliar endophyte communities in montane forest trees," Mar. 2015, 35 Pages.
GenEmbl Database, GenEmbl Record No. JN872548, 38 Pages, Alvarez-Perez, S., et al., "Zooming-in on floral nectar: a first exploration of nectar-associated bacteria in wild plant communities," FEMS Microbiol. Ecol., 2012, vol. 80, No. 3, pp. 591-602.
GenEmbl database, GenEmbl Record No. EU 977189, Jan. 21, 2009, 4 pages, Smith, S.A., et al., "Bioactive endophytes warrant intensified exploration and conservation," PloS ONE 3(8):E3052, 2008.
GenEmbl database, GenEmbl Record No. KF011597, Paenibacillus strain No. HA 13, Aug. 26, 2013, 5 Pages, Park, H.J., et al., "Isolation and characterization of humic substances-degrading bacteria from the subarctic Alaska grasslands," J Basic Microbiol, 2013.
Hahm, M-S., et al., "Biological Control and Plant Growth Promoting Capacity of Rhizobacteria and Pepper Under Greenhouse and Field Conditions," The Journal of Microbiology, The Microbiological Society of Korea, Heidelberg, Jun. 30, 2012, pp. 380-385, vol. 50, No. 3.
Labeda, D.P., et al., "Phylogenetic study of the species within the family Streptomycetaceae," Antonie van Leeuwenhoek, 2012, vol. 101, pp. 73-104, Springer.

(56) References Cited

OTHER PUBLICATIONS

Op De Beeck, M., et al., "Comparison and Validation of Some Its Primer Pairs Useful for Fungal Metabarcoding Studies," PLOS ONE, Jun. 2014, vol. 9, Issue 6, e97629, pp. 1-11.
Zhang, J., et al: "Isolation and Characterization of Plant Growth-Promoting Rhizobacteria from Wheat Roots by Wheat Germ Agglutinin Labeled with Fluorescein Isothiocyanate", The Journal of Microbiology, Apr. 27, 2012, vol. 50, No. 2, pp. 191-198, GenBank Accession No. JN210900.
Riken, Gi No. GMFL01-01-D03, 2 Pages, [online] [Retrieved on Dec. 18, 2017] Retrieved from the internet <URL:http://spectra.psc.riken.jp/menta.cgi/rsoy/datail?id=GMFL01-01-D03>.
NCBI, GenBank: AF034210.1 "Glycine max aspartate aminotransferase glyoxysomal isozyme AAT1 precursor and aspartate aminotransferase cytosolic isozyme AAT2 (AAT) mRNA, complete cds," May 26, 1998, 2 Pages, can be retrieved at <URL:https://www.ncbi.nlm.nih.gov/nuccore/AF034210>.
NCBI, GenBank: JN210900.1, "*Enterobacter* sp. WS05 16S ribosomal RNA gene, partial sequence," Sep. 24, 2012, 1 Page, can be retrieved at <URL:https://www.ncbi.nlm.nih.gov/nuccore/jn210900>.
NCBI, GenBank: NP_001237541.1, "aspartate aminotransferase glyoxysomal isozyme AAT1 precursor [Glycine max]," Oct. 29, 2016, 2 Pages, can be retrieved at <URL:https://www.ncbi.nlm.nih.gov/protein/NP_001237541.1>.
Dbget, "Orthology: K14454," 2005, 2 pages, can be retrieved at <URL:http://www.genome.jp/dbget-bin/www_bget?ko:K14454>.
Gebhardt, J., et al., "Characterization of a single soybean cDNA encoding cytosolic and glyoxysomal isozymes of aspartate aminostransferase," Plant Molecular Biology, 1998, pp. 99-108, vol. 37.

\* cited by examiner

AGRICULTURAL ENDOPHYTE-PLANT COMPOSITIONS, AND METHODS OF USE

CROSS-REFERENCE TO RELATED APPLICATIONS

This application is a § 371 National Stage Application of International Application No. PCT/US2014/054160, which claims priority to U.S. Provisional Application Ser. No. 61/959,871 filed Sep. 4, 2013; U.S. Provisional Application Ser. No. 61/959,875, filed Sep. 4, 2013; U.S. Provisional Application Ser. No. 61/959,870 filed Sep. 4, 2013; U.S. Provisional Application Ser. No. 61/959,861 filed Sep. 4, 2013; U.S. patent application Ser. No. 14/316,469, filed Jun. 26, 2014, and International Application No. PCT/US2014/044427, filed Jun. 26, 2014, the disclosures of which are incorporated herein by reference in their entirety.

SEQUENCE LISTING

The instant application contains a Sequence Listing with 1470 sequences which has been submitted electronically in ASCII format and is hereby incorporated by reference in its entirety. Said ASCII copy, created on Feb. 23, 2015, is named 28727US_CRF_sequencelisting.txt and is 1,951,930 bytes in size.

TECHNICAL FIELD

This application relates to methods and materials for providing a benefit to a seed or seedling of an agricultural plant such as a *Glycine* plant, particularly a *Glycine max* plant, or an agricultural grass plant, particularly a cereal, or an agricultural plant such as a *Glycine* plant (e.g., a *Glycine max* plant) or an agricultural grass plant derived from the seed or seedling. For example, this application provides purified bacterial populations that include novel seed bacterial endophytes, and synthetic combinations of seeds and/or seedlings with seed-derived bacterial endophytes such as heterologous seed-derived bacterial endophytes. Such seed bacterial endophytes can provide beneficial properties to the seed, seedling, or the agricultural plant derived from the seed or seedling, including beneficial properties related to metabolic, transcriptional, or proteome alterations, morphology, and the resilience to a variety of environmental stresses, and combination of such properties.

BACKGROUND

Economically-, environmentally-, and socially-sustainable approaches to agriculture and food production are required to meet the needs of a growing global population. By 2050 the United Nations' Food and Agriculture Organization projects that total food production must increase by 70% to meet the needs of the growing population, a challenge that is exacerbated by numerous factors, including diminishing freshwater resources, increasing competition for arable land, rising energy prices, increasing input costs, and the likely need for crops to adapt to the pressures of a drier, hotter, and more extreme global climate. The need to grow nearly twice as much food with less water in more arid climates is driving a critical need for innovations in crop water use efficiency and temperature tolerance.

Today, crop performance is optimized primarily via technologies directed towards the interplay between crop genotype (e.g., plant breeding, genetically-modified (GM) crops) and its surrounding environment (e.g., fertilizer, synthetic herbicides, and/or pesticides). While these paradigms have assisted in doubling global food production in the past fifty years, yield growth rates have stalled in many major crops, and shifts in the climate have been linked to production instability and declines in important crops such as wheat, driving an urgent need for novel solutions to crop yield improvement. In addition to their long development and regulatory timelines, public fears of GM-crops and synthetic chemicals has challenged their use in many key crops and countries, resulting in a lack of acceptance for GM traits in wheat and the exclusion of GM crops and many synthetic chemistries from European markets. Thus, there is a significant need for innovative, effective, environmentally-sustainable, and publically-acceptable approaches to improving the yield and resilience of crops to severe abiotic and biotic stresses.

Improvement of crop resilience to abiotic stresses such as heat and drought stress and some biotic stresses has proven challenging for conventional genetic and chemical paradigms for crop improvement. This challenge is in part due to the complex, network-level changes that arise during exposure to these stresses. For example, plants under such stress can succumb to a variety of different types of physiological and developmental damages, including, for example, dehydration, elevated reactive oxygen species, impairment of photosynthetic carbon assimilation, inhibition of translocation of assimilates, increased respiration, reduced organ size due to a decrease in the duration of developmental phases, disruption of seed development, and a reduction in fertility.

Like humans, who utilize a complement of beneficial microbial symbionts, plants have been purported to derive a benefit from the array of bacteria and fungi that live both within and around their tissues in order to support the plant's health and growth. As described in detail herein, endophytes are fungal or bacterial organisms that live within plants. Bacterial endophytes, such as Firmicutes, Actinobacteria, Proteobacteria, Bacteroidetes, and Verrucomicrobia, appear to inhabit various host plant tissues and have been isolated from plant leaves, stems, and roots.

To date, a small number of these symbiotic endophyte-host relationships have been analyzed in limited studies to provide fitness benefits to model host plants within controlled laboratory settings, such as enhancement of biomass production (i.e., yield) and nutrition, increased tolerance to stress such as drought and pests. Yet, such endophytes have been demonstrated to be ineffective or of limited efficacy in conferring benefits to a variety of agriculturally-important plants such as soybean or modern cereals; as such, they do not adequately address the need to provide improved yield and tolerance to environmental stresses present in many agricultural situations for such crops, particularly drought and heat.

Thus, there is a need for compositions and methods of providing agricultural crops with improved yield and resistance to various abiotic and biotic stresses. Provided herein are novel compositions of symbionts, bacterial and fungal endophytes, as well as novel symbiont-plant compositions, created based on the analysis of the key properties that enhance the utility and commercialization of an endophytic composition.

SUMMARY

The present invention is based, in part, on the surprising discovery that endophytic microbes found in dry mature seeds of plants can confer important multiple benefits when applied to soy and cereal seeds and seedlings. The inventors have isolated and extensively characterized a large number of bacterial and fungal endophytes of seed that are able to colonize *Glycine* plants (e.g., soybean plants) and agricultural grass plants and to provide beneficial traits to these plants. As such, provided herein are purified bacterial and fungal populations that contain one or more populations of seed endophytes, particularly bacterial endophytes (herein referred to as seed bacterial endophytes), compositions (e.g., agricultural formulations and articles of manufacture) that include such purified bacterial populations, as well as synthetic combinations of such purified bacterial populations in association with seeds or seedlings of an agricultural plant and other agricultural products, including seeds. In addition, provided herein are methods of using such seed bacterial endophytes to prepare synthetic combinations, agricultural seed preparations, agricultural formulations, articles of manufacture, seed treatments, or other agricultural products, and to provide benefits to agricultural plants. Seed-derived endophytes can confer significant advantages to agricultural crops such as soybean or cereal crops, spanning growth under normal and stressed conditions, altered expression of key plant hormones, altered expression of key transcripts in the plant, and other desirable features.

As described herein, beneficial microbes can be robustly derived from agricultural seeds, cultured, administered, in some embodiments, heterologously to agricultural seeds or seedlings (e.g., seeds or seedlings of a *Glycine max* or a Poaceae (also known as Gramineae, and can be used interchangeably) agricultural plant), and colonize the resulting plant tissues with high efficiency to confer multiple beneficial properties (e.g., two, three, four, or more beneficial properties or traits) that are durably retained in the plants and their progeny. This is surprising given the historically observed variability in microbe isolation from healthy seeds and the previous observations of inefficient seed pathogen colonization of a plant host's tissues. Further, the ability of heterologously disposed seed bacterial endophytes to colonize seeds and seedlings from the exterior surface of seeds is surprising given that such endophytes can be isolated from within internal seed tissues and therefore may not natively need the capacity to penetrate and invade into internal host tissues in their natural state.

Seed bacterial endophytes can be heterologously disposed onto seedlings of a distinct cultivar, species, or crop type (e.g., cereal or soybean) and confer benefits to those new recipients. For example, seed bacterial endophytes from corn cultivars can be heterologously provided to wheat cultivars to confer a benefit. This is surprising given the prior observations of distinct microbiome preferences in distinct plant and mammalian hosts and, in particular, the likelihood that microbes derived from seeds may have been co-evolved to be specialized to a particular host.

Provided are methods for preparing an agricultural seed preparation, including: a) contacting the surface of a plurality of *Glycine* agricultural plant seeds with a formulation including a purified bacterial population at a concentration of at least about $10^2$ CFU/ml in a liquid formulation or about $10^2$ CFU/gm in a non-liquid formulation, the bacterial population including a seed bacterial endophyte exhibiting the ability to produce or induce in a *Glycine* agricultural plant grown from the *Glycine* agricultural plant seed an activity selected from production of an auxin, production of an antimicrobial, production of a siderophore, mineral phosphate solubilization, production of a cellulase, production of a chitinase, production of a xylanase, and production of acetoin, wherein the seed bacterial endophyte is present in the formulation in an amount capable of providing a benefit to the plant seeds or to agricultural plants derived from the plant seeds, wherein the formulation further comprises a stabilizer, a fungicide, a preservative, or a combination thereof; and b) packaging the contacted seeds in a container. In some embodiments, the bacterial endophyte is amplified within a tissue of the *Glycine* agricultural plant. Also, the contacted seeds are packaged in the container such that they are substantially stable at about 25 degrees C. for at least 7 days.

Also, the bacterial endophyte comprises the ability to induce in the *Glycine* agricultural plant at least two activities selected from production of an auxin, production of an antimicrobial, production of a siderophore, mineral phosphate solubilization, production of a cellulase, production of a chitinase, production of a xylanase, and production of acetoin. Also the contacted seeds and/or the *Glycine* agricultural plant grown therefrom comprises an increased production of a polypeptide and/or ii) a reduced production of a polypeptide compared to a reference *Glycine* agricultural plant. In some embodiments, the contacting in (a) comprises spraying, immersing, coating, encapsulating, injecting or dusting the seeds with the formulation. In some embodiments, the purified bacterial population comprises a plurality of seed bacterial endophyte entities. In some embodiments, the purified bacterial population comprises a plurality of taxonomically diverse seed bacterial endophyte entities. In some embodiments, the bacterial population comprises a bacterial endophyte including a 16S nucleic acid sequence at least 97% identical to a bacterial endophyte selected from Table 1. In some embodiments, the purified bacterial population comprises i) a first bacterial endophyte including a first 16S nucleic acid sequence at least 97% identical to a bacterial endophyte selected from Table 1, and ii) a second bacterial endophyte including a second 16S nucleic acid sequence at least 97% identical to a bacterial endophyte selected from Table 1, wherein the first and second 16S nucleic acid sequence are not 100% identical. In some embodiments, the contacting results in a concentration of at least $10^2$ CFU of the bacterial endophyte on the surface of the seed. In some embodiments, the bacterial population is obtained from an interior seed compartment and/or wherein the bacterial population comprises a seed bacterial endophyte. In some embodiments, the bacterial population is obtained from a plant species other than the seeds to which the formulation is contacted. In some embodiments, the bacterial population is obtained from a plant species other than the seeds to which the formulation is contacted, and wherein the bacterial population is propagated in culture. In some embodiments, the bacterial population is obtained from a plant cultivar or a seed thereof different from the cultivar of the seeds to which the formulation is contacted. In some embodiments, the bacterial population is obtained from a surface sterilized seed. In some embodiments, the bacterial population provides a benefit capable of being maternally inherited by progeny of the contacted plant seeds. In some embodiments, the bacterial population provides a benefit capable of being paternally inherited by progeny of the contacted plant seeds. In some embodiments, the bacterial population is derived or obtained from i) a rice, maize, wheat, soy, or barley seed, or ii) from an agricultural plant grown from the seed. In some embodiments, the bacterial population is derived or obtained from a monocot seed. In some embodiments, the bacterial population is derived or obtained from a dicot seed. In some embodiments, the contacted plant seed has least one activity selected from at least two phenotypes or activities selected from the group consisting of production of an auxin, production of an antimicrobial, production of a siderophore, mineral phosphate solubilization, production of a cellulase, production of a chitinase, production of a xylanase, and acetoin production, and ii) inducing in the *Glycine* agricultural plant and/or the *Glycine* agricultural plant seed the production of a polypeptide. In some embodiments, the benefit is selected from the group consisting of: increased root biomass, increased root length, increased height, increased shoot length, increased leaf number, increased water use efficiency, increased overall biomass, increase yield, increased photosynthesis rate, increased tolerance to drought, increased heat tolerance, increased salt tolerance, increased resistance to nematode stress, increased resistance to a fungal pathogen, increased resistance to a bacterial pathogen, increased resistance to a viral pathogen, a detectable modulation in the level of a metabolite, and a detectable modulation in the proteome, relative to reference seeds or agricultural plants derived from reference seeds. In some embodiments, the benefit comprises at least two benefits selected from the group consisting of: increased root biomass, increased root length, increased height, increased shoot length, increased leaf number, increased water use efficiency, increased overall biomass, increase yield, increased photosynthesis rate, increased tolerance to drought, increased heat tolerance, increased salt tolerance, increased resistance to nematode stress, increased resistance to a fungal pathogen, increased resistance to a bacterial pathogen, increased resistance to a viral pathogen, a detectable modulation in the level of a metabolite, and a detectable modulation in the proteome, relative to reference seeds or agricultural plants derived from reference seeds.

In another aspect, provided are methods of making an agricultural seed preparation, the method including: (a) contacting the surface of a plurality of *Glycine max* seeds with a formulation including a purified bacterial population at a concentration of at least about $10^2$ CFU/mL in a liquid formulation or about $10^2$ CFU/g in a non-liquid formulation, of a seed bacterial endophyte that exhibits at least one activity selected from the group consisting of: production of an auxin, production of an antimicrobial, production of a siderophore, mineral phosphate solubilization, production of a cellulase, production of a chitinase, production of a xylanase, and production of acetoin, and (b) packaging the contacted seeds in packaging material In some embodiments, the contacted seeds are shelf-stable at about 25 degrees C. for at least 6 months. In some embodiments, the seed bacterial endophyte exhibits at least two activities selected from the group consisting of: production of an auxin, production of an antimicrobial, production of a siderophore, mineral phosphate solubilization, production of a cellulase, production of a chitinase, production of a xylanase, and production of acetoin. In some embodiments, the seed bacterial endophyte is present in the formulation in an amount capable of modulating a trait in *Glycine max* selected from the group consisting of: root biomass, root length, height, shoot length, leaf number, water use efficiency, overall biomass, yield, photosynthesis rate, tolerance to drought, heat tolerance, salt tolerance, resistance to nematode stress, resistance to a fungal pathogen, resistance to a bacterial pathogen, resistance to a viral pathogen, the level of a metabolite, and proteome expression profile. In some embodiments, the bacterial endophyte comprises the ability to i) increase in the *Glycine* agricultural plant and/or the *Glycine* agricultural plant seed the production of a polypeptide provided herein and/or ii) reduce in the *Glycine* agricultural plant and/or the *Glycine* agricultural plant seed the production of a polypeptide provided herein. In some embodiments, the trait is selected from the group consisting of: water use efficiency, yield, tolerance to drought, heat tolerance, salt tolerance, resistance to nematode stress, resistance to a fungal pathogen, resistance to a bacterial pathogen, and resistance to a viral pathogen. In some embodiments, the contacting step comprises spraying, immersing, coating, encapsulating, injecting, or dusting the seeds with the formulation. In some embodiments, the purified bacterial population comprises a plurality of different seed bacterial endophytes. In some embodiments, the purified bacterial population comprises a plurality of seed bacterial endophytes from different OTUs. In some embodiments, the purified bacterial population comprises a seed bacterial endophyte including a 16S nucleic acid sequence at least 97% identical to a 16S nucleic acid sequence of a bacterial endophyte set forth in Table 1 or Table 2. In some embodiments, the purified bacterial population comprises (i) a first seed bacterial endophyte including a first 16S nucleic acid sequence at least 97% identical to a 16S nucleic acid sequence from a bacterial endophyte set forth in Table 1 or Table 2, and (ii) a second seed bacterial endophyte including a second 16S nucleic acid sequence at least 97% identical to a 16S nucleic acid sequence from a bacterial endophyte set forth in Table 1 or Table 2, wherein the first and second 16S nucleic acid sequences are not 100% identical. In some embodiments, the first seed bacterial endophyte and the second seed bacterial endophyte synergistically increase at least one of water use efficiency, yield, tolerance to drought, heat tolerance, salt tolerance, resistance to nematode stress, resistance to a fungal pathogen, resistance to a bacterial pathogen, and resistance to a viral pathogen. In some embodiments, the contacting results in a concentration of at least $10^2$ CFU/seed on the surface of the seeds. In some embodiments, the purified bacterial population comprises (i) a first seed bacterial endophyte including a first 16S nucleic acid sequence at least 97% identical to a 16S nucleic acid sequence from a bacterial endophyte set forth in Table 1 or Table 2, (ii) a second seed bacterial endophyte including a second 16S nucleic acid sequence at least 97% identical to a 16S nucleic acid sequence from a bacterial endophyte set forth in Table 1 or Table 2, and (iii) a third seed bacterial endophyte including a third 16S nucleic acid sequence at least 97% identical to a 16S nucleic acid sequence from a bacterial endophyte set forth in Table 1 or Table 2, wherein the first and second and third 16S nucleic acid sequences are not 100% identical. In some embodiments, at least two of the first seed bacterial endophyte, the second seed bacterial endophyte and the third seed bacterial endophyte synergistically increase at least one of water use efficiency, yield, tolerance to drought, heat tolerance, salt tolerance, resistance to nematode stress, resistance to a fungal pathogen, resistance to a bacterial pathogen, and resistance to a viral pathogen. In some embodiments, the seed bacterial endophyte is obtained from a plant species other than the seeds to which the formulation is contacted. In some embodiments, the seed bacterial endophyte is obtained or is obtainable from a plant cultivar different from the cultivar of the seeds to which the formulation is contacted. In some embodiments, the seed bacterial endophyte is obtained or is obtainable from a surface sterilized seed. In some embodiments, the trait is maternally inherited by progeny of the contacted plant seeds. In some embodiments, the seed bacterial endophyte is obtained or obtainable from a monocot seed such as rice, maize, wheat, or barley. In some embodiments, the seed bacterial endophyte is obtained or obtainable from a dicot seed. In some embodiments, the modulation of a trait is selected from the group consisting of:

increased root biomass, increased root length, increased height, increased shoot length, increased leaf number, increased water use efficiency, increased overall biomass, increase yield, increased photosynthesis rate, increased tolerance to drought, increased heat tolerance, increased salt tolerance, increased resistance to nematode stress, increased resistance to a fungal pathogen, increased resistance to a bacterial pathogen, increased resistance to a viral pathogen, an increase in the level of a metabolite, and a detectable modulation in proteome expression profile, as compared to corresponding reference *Glycine max* plants. In some embodiments, the modulation of a trait comprises at least two of: increased root biomass, increased root length, increased height, increased shoot length, increased leaf number, increased water use efficiency, increased overall biomass, increase yield, increased photosynthesis rate, increased tolerance to drought, increased heat tolerance, increased salt tolerance, increased resistance to nematode stress, increased resistance to a fungal pathogen, increased resistance to a bacterial pathogen, increased resistance to a viral pathogen, an increase in the level of a metabolite, and a detectable modulation in the proteome expression profile, as compared to a corresponding reference *Glycine max* plant. In some embodiments, the formulation further comprises one or more of a fungicide, a nematicide or an insecticide.

In another aspect, provided are methods of making a seed treatment, the method including: (a) inoculating an isolated cultured bacterial endophyte selected from Table 1 into a liquid medium; (b) culturing the bacterial endophyte in the medium at a temperature of about 4 to about 37 degrees C. until the cell or spore density in the medium is at least about $10^2$ CFU/mL; and (c) collecting the vegetative cells or spores under conditions suitable to produce a seed treatment. In some embodiments the method further includes (d) removing water from the collected vegetative cells or spores to form a seed treatment concentrate.

Also provided is a method for generating a synthetic agricultural preparation, including: a) contacting the surface of a plurality of *Glycine* agricultural plant seeds with a agriculturally acceptable formulation including a bacterial culture at a concentration of at least about $10^2$ CFU/ml in a liquid formulation or a purified cultured bacterial population at a concentration of at least about $10^2$ CFU/gm in a non-liquid formulation, wherein the bacterial culture or bacterial population are capable of production of an auxin, production of an antimicrobial, production of a siderophore, mineral phosphate solubilization, production of a cellulase, production of a chitinase, production of a xylanase, or production of acetoin, in an agricultural plant grown from the plant seeds.

Also provided are methods for preparing an agricultural preparation, wherein said method comprises i) inoculating an isolated cultured bacterial entity selected from Table 1 or a culture thereof into a liquid medium; ii) allowing the bacterial entity to grow at a temperature of about 4 to about 37 degrees C. for a quantity of time sufficient to produce a concentration of vegetative cells or spores of at least about $10^2$ per milliliter or per gram, and iii) purifying the vegetative cells or spores under conditions suitable to produce an agricultural preparation. In some embodiments, the method further includes the step of removing water from the purified vegetative cells or spores without a substantial loss of vegetative cell or spore viability.

Also provided are methods for treating seedlings, the methods including: a) contacting foliage or the rhizosphere of a plurality of *Glycine* agricultural plant seedlings with a formulation including a purified bacterial population at a concentration of at least about $10^2$ CFU/ml in a liquid formulation or about $10^2$ CFU/g in a non-liquid formulation, wherein a substantial component of the CFUs present in the formulation comprise a seed bacterial endophyte exhibiting the ability to induce in the *Glycine* agricultural plant seedlings an activity selected from production of an auxin, production of an antimicrobial compound, production of a siderophore, mineral phosphate solubilization, production of a cellulase, production of a chitinase, production of a xylanase, and production of acetoin, and wherein the seed bacterial endophyte is capable of propagating in the seedlings to an amount sufficient to provide a benefit to the seedlings or to agricultural plants derived from the seedlings; and b) growing the contacted seedlings under conditions such that the bacterial endophytes are viably retained in the seedlings.

Also provided are methods for modulating a *Glycine* plant trait including: a) applying to *Glycine* vegetation or an area adjacent the vegetation, a formulation including a purified bacterial population at a concentration of at least about $10^2$ CFU/ml in a liquid formulation or about $10^2$ CFU/g in a non-liquid formulation including a seed bacterial endophyte exhibiting the ability to induce in the *Glycine* vegetation an activity selected from production of an auxin, production of an antimicrobial compound, production of a siderophore, mineral phosphate solubilization, production of a cellulase, production of a chitinase, production of a xylanase, and production of acetoin, wherein the formulation is capable of providing a benefit to the vegetation, or to a crop produced from the vegetation.

Also provided is a method for modulating the soil environment of a *Glycine* plant, including contacting a *Glycine* plant or seed thereof with a purified bacterial population including a bacterial entity selected from Table 1 under conditions such that the *Glycine* plant i) removes from the soil environment at least one soil compound, and/or ii) introduces into the soil environment at least one soil compound not detectably present in the soil environment of a *Glycine* plant, not contacted with an effective amount of a purified bacterial population.

Also provided is a method for modulating a *Glycine* plant trait including: applying a formulation to soil, the formulation including a purified bacterial population at a concentration of at least about $10^2$ CFU/g, including a bacterial endophyte exhibiting the ability to induce in a *Glycine* agricultural plant present in the soil an activity selected from production of an auxin, production of an antimicrobial compound, production of a siderophore, mineral phosphate solubilization, production of a cellulase, production of a chitinase, production of a xylanase, and production of acetoin, wherein the formulation is capable of providing a benefit to seeds planted within the formulation-applied soil, or to a crop produced from the *Glycine* plants grown in the soil. In some embodiments, the bacterial endophyte comprises a 16S nucleic acid sequence having at least 97% sequence identity to the 16S nucleic acid sequence of a bacterial endophyte selected from a genus provided in Table 1 or a family provided in Table 2. In some embodiments, the bacterial endophyte is derived or obtained from i) a rice, maize, wheat, soy, or barley seed, or ii) from an agricultural plant grown from the seed.

Also provided is a method of screening a modulator of a *Glycine* trait, including: (a) applying a library of bacterial entities to a population of seeds of a *Glycine* agricultural plant; (b) measuring a trait in seedlings or plants derived from the seeds, the trait selected from the group consisting of root biomass, root length, height, shoot length, leaf number, water use efficiency, overall biomass, yield, photosynthesis rate, tolerance to drought, heat tolerance, salt tolerance, resistance to nematode stress, resistance to a fungal pathogen, resistance to a bacterial pathogen, resistance to a viral pathogen, the level of a metabolite, and proteome expression; and (c) identifying at least one of the bacterial entities present in the library capable of modulating the trait, relative to reference seedlings or plants. In some embodiments, the library comprises at least about 10-100 bacteria of one or more species of bacterial endophytes. In some embodiments, the bacterial endophytes comprise seed bacterial endophytes.

Also provided is a method of identifying a modulator of a plant trait, including: (a) applying a bacterial population to seeds of a *Glycine* agricultural plant, the population including bacteria of one or more species of bacterial endophytes; (b) measuring a trait in seedlings or plants derived from the seeds, the trait selected from the group consisting of root biomass, root length, height, shoot length, leaf number, water use efficiency, overall biomass, yield, photosynthesis rate, tolerance to drought, heat tolerance, salt tolerance, resistance to nematode stress, resistance to a fungal pathogen, resistance to a bacterial pathogen, resistance to a viral pathogen, the level of a metabolite, and proteome expression; and (c) identifying at least one of the traits for which the bacterial population results in a modulation of the trait, relative to reference seedlings or plants. In some embodiments, the bacterial endophytes comprise a plurality of seed bacterial endophyte entities.

Also provided is a method of identifying a modulator of a plant trait, including: (a) applying a bacterial population to seedlings of an agricultural plant, the population including bacteria of one or more species of seed bacterial endophytes; (b) measuring a trait in the seedlings or in plants derived from the seedlings, the trait selected from the group consisting of root biomass, root length, height, shoot length, leaf number, water use efficiency, overall biomass, yield, photosynthesis rate, tolerance to drought, heat tolerance, salt tolerance, resistance to nematode stress, resistance to a fungal pathogen, resistance to a bacterial pathogen, resistance to a viral pathogen; the level of a metabolite, and proteome expression; and (c) identifying at least one of the traits for which the bacterial population results in a modulation of the trait, relative to reference seedlings or plants. In some embodiments, the bacterial endophytes comprise a plurality of seed bacterial endophyte entities.

In another aspect, provided are synthetic combinations including a purified bacterial population in association with a plurality of seeds or seedlings of a *Glycine* agricultural plant, wherein the purified bacterial population comprises a bacterial endophyte capable of at least one of: production of an auxin, production of an antimicrobial, production of a siderophore, mineral phosphate solubilization, production of a cellulase, production of a chitinase, production of a xylanase, and production of acetoin, or a combination of two or more thereof, and wherein the seed bacterial endophyte is present in the synthetic combination in an amount effective to provide a benefit to the seeds or seedlings or the plants derived from the seeds or seedlings. In some embodiments, the bacterial endophytes comprise a plurality of seed bacterial endophyte entities. In some embodiments, the synthetic combination is disposed within a packaging material selected from a bag, box, bin, envelope, carton, or container. In some embodiments, the combination includes 1000 seed weight amount of seeds, wherein the packaging material optionally comprises a dessicant, and wherein the synthetic combination optionally comprises an anti-fungal agent. In some embodiments, the bacterial population comprises a first seed bacterial endophyte having a first 16S nucleic acid sequence and a second seed bacterial endophyte having a second 16S nucleic acid sequence, wherein the first and the second 16S nucleic acid sequences are less than 97% identical. (e.g., 90-96%, 90-97%, 90%, 91%, 92%, 93%, 94%, 95%, or 96% identical).

Also provided is an agricultural product including a 1000 seed weight amount of a synthetic combination produced by the step of contacting a plurality of *Glycine* agricultural plant seeds with a liquid formulation including a bacterial population at a concentration of at least 1 CFU per agricultural plant seed, under conditions such that the formulation is associated with the surface of the seeds in a manner effective for the bacterial endophytes to confer a benefit to the seeds or to a crop including a plurality of agricultural plants produced from the seeds.

Also provided is a synthetic combination including a purified bacterial population in association with a plurality of seeds or seedlings of a *Glycine* agricultural plant, wherein the purified bacterial population is capable of providing a benefit selected from the group consisting of: increased root biomass, increased root length, increased height, increased shoot length, increased leaf number, increased water use efficiency, increased overall biomass, increase yield, increased photosynthesis rate, increased tolerance to drought, increased heat tolerance, increased salt tolerance, increased resistance to nematode stress, increased resistance to a fungal pathogen, increased resistance to a bacterial pathogen, increased resistance to a viral pathogen, a detectable modulation in the level of a metabolite, and a detectable modulation in the proteome relative to a reference plant, or a combination thereof.

Also provided is an article of manufacture, including: (a) packaging material; (b) *Glycine* plant seeds within the packaging material, and (c) at least one species of bacterial endophyte associated with the seeds.

Also provided is a synthetic combination including a purified bacterial population in association with a plurality of seeds or seedlings of a *Glycine* agricultural plant, wherein the purified bacterial population comprises a first bacterial endophyte entity and a second bacterial endophyte entity, wherein the first and second bacterial endophyte entities are not identical. In some embodiments, the first and second bacterial endophyte entities synergistically induce in the *Glycine* agricultural plant at least one trait selected from the group consisting of root biomass, root length, height, shoot length, leaf number, water use efficiency, overall biomass, yield, photosynthesis rate, tolerance to drought, heat tolerance, salt tolerance, resistance to nematode stress, resistance to a fungal pathogen, resistance to a bacterial pathogen, resistance to a viral pathogen, the level of a metabolite, and proteome expression. In some embodiments, the first and second bacterial endophyte entities synergistically induce in the *Glycine* agricultural plant at least one activity selected from production of an auxin, production of an antimicrobial compound, production of a siderophore, mineral phosphate solubilization, production of a cellulase, production of a chitinase, production of a xylanase, and production of acetoin. In some embodiments, the first bacterial endophyte entity is derived or obtained from a first seed, and wherein the second bacterial endophyte entity is derived or obtained from a second seed. In some embodiments, the first and second bacterial endophyte entities are independently capable of forming spores. In some embodiments, the first and second bacterial endophyte entities synergistically colonize a first tissue of the *Glycine* agricultural plant. In some embodiments, the first and second bacterial endophyte entities colonize a plurality of tissues of the *Glycine* agricultural plant. In some embodiments, the first bacterial endophyte entity is a member of a first phylum, and wherein the second bacterial endophyte entity is a member of a second phylum. In some embodiments, the first and second bacterial endophyte entities synergistically induce in the *Glycine* agricultural plant the production of a polypeptide provided herein. In some embodiments, the first bacterial endophyte entity is capable of modulating in the *Glycine* agricultural plant the production of a first polypeptide provided herein, and wherein the second bacterial endophyte entity is capable of modulating in the *Glycine* agricultural plant the production of a second polypeptide provided herein. In some embodiments, the first bacterial endophyte entity is derived or obtained from a first seed selected from a *Glycine soja*, rice, maize, wheat, or barley seed.

Also provided is a method of identifying a modulator of a *Glycine max* trait, the method including: a) contacting *Glycine max* seeds with one or more species of seed bacterial endophytes; (b) measuring a trait in plants grown from the contacted seeds, the trait selected from the group consisting of root biomass, root length, height, shoot length, leaf number, water use efficiency, overall biomass, yield, photosynthesis rate, tolerance to drought, heat tolerance, salt tolerance, resistance to nematode stress, resistance to a fungal pathogen, resistance to a bacterial pathogen, resistance to a viral pathogen, the level of a metabolite, and proteome expression; and (c) identifying one or more seed bacterial endophytes for which the contacted plants exhibit a modulation in at least one of the traits, relative to a corresponding reference plant grown from seeds that have not been contacted with the one or more species of seed bacterial endophytes. In some embodiments, the one or more seed bacterial endophytes are selected from a library including at least 100 species of seed bacterial endophytes. In some embodiments, the method further includes the step of treating the seeds with one or more of a fungicide, a nematicide or an insecticide, prior to or subsequent to the contacting step. In some embodiments, the measuring step comprises measuring the trait in plants grown in soil. In some embodiments, the one or more seed bacterial endophytes are obtained from a *Glycine soja* seed.

Also provided is a synthetic combination including a purified bacterial population in association with a plurality of seeds or seedlings of a *Glycine max* plant, wherein the purified bacterial population comprises a bacterial endophyte that exhibits at least one (e.g., at least two) activity selected from the group consisting of: production of an auxin, production of an antimicrobial, production of a siderophore, mineral phosphate solubilization, production of a cellulase, production of a chitinase, production of a xylanase, and production of acetoin, and wherein the seed bacterial endophyte is present in the synthetic combination in an amount effective to provide a trait to a similar *Glycine max* seed, seedling, or plant. In some embodiments, the bacterial endophyte is a seed bacterial endophyte. In some embodiments, the synthetic combination is disposed within a packaging material selected from a bag, box, bin, envelope, carton, or container. In some embodiments, the combination includes 1000 seed weight amount of seeds, wherein the packaging material optionally further comprises a dessicant, and wherein the synthetic combination optionally further comprises an anti-fungal agent. In some embodiments, the purified bacterial population comprises a first seed bacterial endophyte having a first 16S nucleic acid sequence and a second seed bacterial endophyte having a second 16S nucleic acid sequence, wherein the first and the second 16S nucleic acid sequences are less than 97% identical (e.g., 90-96%, 90-97%, 90%, 91%, 92%, 93%, 94%, 95%, or 96% identical).

Also provided is an agricultural product including a 1000 seed weight amount of a synthetic combination produced by a method that comprises contacting a plurality of *Glycine max* seeds with a liquid formulation including a seed bacterial endophyte at a concentration of at least 1 CFU per seed, under conditions that allow the formulation to associate with the seeds in a manner effective for the seed bacterial endophytes to confer a trait to the seeds or to a crop including a plurality of agricultural plants produced from the seeds.

Also provided is a synthetic combination including a purified bacterial population in association with a plurality of seeds or seedlings of a *Glycine max* plant, wherein the purified bacterial population is capable of providing to a *Glycine max* seed, seedling, or plant, as compared to a reference *Glycine max* seed, seedling, or plant, at least one trait selected from the group consisting of: increased root biomass, increased root length, increased height, increased shoot length, increased leaf number, increased water use efficiency, increased overall biomass, increase yield, increased photosynthesis rate, increased tolerance to drought, increased heat tolerance, increased salt tolerance, increased resistance to nematode stress, increased resistance to a fungal pathogen, increased resistance to a bacterial pathogen, increased resistance to a viral pathogen, a detectable modulation in the level of a metabolite, and a detectable modulation in the proteome.

Also provided is an article of manufacture, including: (a) a packaging material;

(b) *Glycine max* seeds disposed within the packaging material; and (c) a bacterial population including a seed bacterial endophyte that is associated with the seeds. In some embodiments, the seed bacterial endophyte is obtained from seeds of a dicot species other than *Glycine max*. In some embodiments, the bacterial population comprises at least two different seed bacterial endophyte entities.

Also provided is a synthetic combination including a purified bacterial population in association with a plurality of seeds or seedlings of a *Glycine max* plant, wherein the purified bacterial population comprises a first bacterial endophyte and a second bacterial endophyte, wherein the first and second bacterial endophytes are not identical. In some embodiments, the first and second bacterial endophytes synergistically induce in a *Glycine max* plant, as compared to a reference *Glycine max* plant, at least one trait selected from the group consisting of root biomass, root length, height, shoot length, leaf number, water use efficiency, overall biomass, yield, photosynthesis rate, tolerance to drought, heat tolerance, salt tolerance, resistance to nematode stress, resistance to a fungal pathogen, resistance to a bacterial pathogen, resistance to a viral pathogen, the level of a metabolite, and proteome expression. In some embodiments, the first and second bacterial endophytes exhibit at least one activity selected from the group consisting of: production of an auxin, production of an antimicrobial compound, production of a siderophore, mineral phosphate solubilization, production of a cellulase, production of a chitinase, production of a xylanase, and production of acetoin. In some embodiments, the first bacterial endophyte was derived or obtained from a first seed, and wherein the second bacterial endophyte was derived or obtained from a second seed. In some embodiments, the first and second bacterial endophytes are independently capable of forming spores. In some embodiments, the first and second bacterial endophytes synergistically colonize a first tissue of a *Glycine max* plant. In some embodiments, first and second bacterial endophytes colonize a plurality of tissues of a *Glycine max* plant. In some embodiments, the first bacterial endophyte is a member of a first phylum and the second bacterial endophyte is a member of a second phylum. In some embodiments, the first and second bacterial endophytes synergistically modulate in a *Glycine max* plant, as compared to a reference *Glycine* agricultural plant, production of a polypeptide provided herein. In some embodiments, the first bacterial endophyte is capable of inducing in the *Glycine max* plant, as compared to a reference *Glycine max* plant, an increase in production of a first polypeptide, and wherein the second bacterial endophyte is capable of inducing in the *Glycine max* plant, as compared to a reference *Glycine max* plant, a decrease in production of a second polypeptide.

Also provided is a seed bacterial endophyte that when applied to *Glycine max* seed, confers upon *Glycine max* plants produced from the seed at least one trait selected from the group consisting of: increased root biomass, increased root length, increased height, increased shoot length, increased leaf number, increased water use efficiency, increased overall biomass, increased photosynthesis rate, increased tolerance to drought, increased heat tolerance, increased salt tolerance, increased resistance to nematode stress, increased resistance to a fungal pathogen, increased resistance to a bacterial pathogen, increased resistance to a viral pathogen, an increased level of one or more plant hormones, and an increased level of a metabolite, compared to a reference *Glycine max* plant; and wherein the seed bacterial endophyte comprises a heterologous nucleic acid. In some embodiments, the heterologous nucleic acid encodes a detectable marker. In some embodiments, the heterologous nucleic acid encodes an anti-fungal protein.

Also provided is a composition including an agriculturally acceptable carrier and a purified bacterial population including a seed bacterial endophyte, wherein the composition when applied to a *Glycine max* seed or seedling confers upon a plant grown from the seed or seedling, as compared to a control *Glycine max* plant, at least one trait selected from the group consisting of: increased root biomass, increased root length, increased height, increased shoot length, increased leaf number, increased water use efficiency, increased overall biomass, increased photosynthesis rate, increased tolerance to drought, increased heat tolerance, increased salt tolerance, increased resistance to nematode stress, increased resistance to a fungal pathogen, increased resistance to a bacterial pathogen, increased resistance to a viral pathogen, an increased level of one or more plant hormones, and an increased level of a metabolite. In some embodiments, the agriculturally acceptable carrier is an adhesion agent, an anti-fungal agent, a pesticide, or a fertilizer. In some embodiments, the agriculturally acceptable carrier is a non-naturally occurring compound. In some embodiments, the composition is a liquid formulation. In some embodiments, the composition is a non-liquid formulation. In some embodiments, the composition is formulated as a plurality of particles. In some embodiments, the composition is a gel or slurry.

Also provided is a composition including an agriculturally acceptable carrier and a purified bacterial population including a seed bacterial endophyte exhibiting at least one activity selected from the group consisting of: production of an auxin, production of an antimicrobial, production of a siderophore, mineral phosphate solubilization, production of a cellulase, production of a chitinase, production of a xylanase, and production of acetoin. In some embodiments, the agriculturally acceptable carrier is an adhesion agent, an anti-fungal agent, a pesticide, or a fertilizer. In some embodiments, the agriculturally acceptable carrier is non-naturally occurring molecule. In some embodiments, the composition is a liquid. In some embodiments, the composition is a non-liquid formulation. In some embodiments, the composition is formulated as a plurality of particles. In some embodiments, the composition is a gel or slurry.

Also provided is a population of seed bacterial endophyte-enriched *Glycine max* seeds, the seeds having an endophyte population enriched to comprise 10% or more of a seed bacterial endophyte entity that confers upon plants produced from the seed at least one trait selected from the group consisting of: increased root biomass, increased root length, increased height, increased shoot length, increased leaf number, increased water use efficiency, increased overall biomass, increased photosynthesis rate, increased tolerance to drought, increased heat tolerance, increased salt tolerance, increased resistance to nematode stress, increased resistance to a fungal pathogen, increased resistance to a bacterial pathogen, increased resistance to a viral pathogen, an increased level of one or more plant hormones and an increased level of a metabolite, compared to a reference *Glycine max* plant.

Also provided is a population of seed bacterial endophyte-enriched *Glycine max* seeds, the seeds having an endophyte population enriched to comprise at least $10^2$ CFUs/seed of a seed bacterial endophyte that confers upon plants produced from the seeds at least one trait selected from the group consisting of: increased root biomass, increased root length, increased height, increased shoot length, increased leaf number, increased water use efficiency, increased overall biomass, increased photosynthesis rate, increased tolerance to drought, increased heat tolerance, increased salt tolerance, increased resistance to nematode stress, increased resistance to a fungal pathogen, increased resistance to a bacterial pathogen, increased resistance to a viral pathogen, an increased level of one or more plant hormones and an increased level of a metabolite, compared to a reference *Glycine max* plant.

Also provided is a plurality of coated *Glycine max* seeds, wherein the coating comprises: (a) an adhesion agent; and (b) a seed bacterial endophyte that confers upon plants produced from the seeds, as compared to a reference *Glycine* seed, at least one trait selected from the group consisting of: increased root biomass, increased root length, increased height, increased shoot length, increased leaf number, increased water use efficiency, increased overall biomass, increased photosynthesis rate, increased tolerance to drought, increased heat tolerance, increased salt tolerance, increased resistance to nematode stress, increased resistance to a fungal pathogen, increased resistance to a bacterial pathogen, increased resistance to a viral pathogen, an increased level of one or more plant hormones, and an increased level of a metabolite. In some embodiments, the adhesion agent comprises a non-naturally occurring compound. In some embodiments, the adhesion agent is selected from the group of: a polymer, a co-polymer, and a wax.

Also provided is plurality of coated *Glycine max* seeds, wherein the coating comprises: (a) one or both of a pesticide and a fertilizer; and (b) a seed bacterial endophyte that confers upon plants produced from the seeds at least one trait selected from the group consisting of: increased root biomass, increased root length, increased height, increased shoot length, increased leaf number, increased water use efficiency, increased overall biomass, increased photosynthesis rate, increased tolerance to drought, increased heat tolerance, increased salt tolerance, increased resistance to nematode stress, increased resistance to a fungal pathogen, increased resistance to a bacterial pathogen, increased resistance to a viral pathogen, an increased level of one or more plant hormones, and an increased level of a metabolite, compared to a reference *Glycine max* plant. In some embodiments, the coating comprises a non-naturally occurring pesticide or a non-naturally occurring fertilizer. In some embodiments, the coating further comprises an adhesion agent selected from the group of: a polymer, a co-polymer, and a wax.

Also provided are methods of manufacturing an agricultural product, wherein the method comprises mixing an agriculturally acceptable carrier with a seed bacterial endophyte that confers upon plants produced from the seeds at least one trait selected from the group consisting of: increased root biomass, increased root length, increased height, increased shoot length, increased leaf number, increased water use efficiency, increased overall biomass, increased photosynthesis rate, increased tolerance to drought, increased heat tolerance, increased salt tolerance, increased resistance to nematode stress, increased resistance to a fungal pathogen, increased resistance to a bacterial pathogen, increased resistance to a viral pathogen, an increased level of one or more plant hormones, and an increased level of a metabolite, as compared to a reference *Glycine max* plant. In some embodiments, the agriculturally acceptable carrier is an adhesion agent, an anti-fungal agent, a pesticide, or a fertilizer. In some embodiments, the agriculturally acceptable carrier is non-naturally occurring molecule. In some embodiments, the mixing is performed by spraying, immersing, rolling, encapsulating, or dusting. In some embodiments, the method also includes disposing the agricultural product in packaging material. In some embodiments, the packaging material includes instructions for use of the agricultural product in growing *Glycine max* seeds, or for use in treating soil prior to or subsequent to planting *Glycine* seeds.

Also provided is a method of screening for a modulator of a plant trait, the method including: (a) applying a single entity from a library of bacterial endophyte entities to a population of seeds of an agricultural plant; (b) measuring a trait in plants grown from the seeds, the trait selected from the group consisting of: root biomass, root length, height, shoot length, leaf number, water use efficiency, overall biomass, yield, photosynthesis rate, tolerance to drought, heat tolerance, salt tolerance, resistance to nematode stress, resistance to a fungal pathogen, resistance to a bacterial pathogen, resistance to a viral pathogen, the level of a metabolite, and proteome expression profile; (c) repeating steps (a) and (b) with one or more additional bacterial endophyte entities from the library; and (d) identifying at least one of the bacterial endophyte entities as modulating at least one of the traits, relative to a reference seedling or plant. In some embodiments, the library comprises at least 100 species of seed bacterial endophytes. In some embodiments, one or more of the seed bacterial endophytes are obtained from a plant cultivar different from the cultivar of the population of seeds in step (a). In some embodiments, the bacterial endophytes are seed bacterial endophytes are obtained from one or more surface sterilized seeds. In some embodiments, the seeds are *Glycine max* seeds.

Also provided is a method of identifying a modulator of a plant trait, the method including: a) applying a purified bacterial population to seeds of an agricultural plant, the bacterial population including bacteria of one or more species of seed bacterial endophytes; (b) measuring a trait in plants grown from the seeds, the trait selected from the group consisting of root biomass, root length, height, shoot length, leaf number, water use efficiency, overall biomass, yield, photosynthesis rate, tolerance to drought, heat tolerance, salt tolerance, resistance to nematode stress, resistance to a fungal pathogen, resistance to a bacterial pathogen, resistance to a viral pathogen, the level of a metabolite, and proteome expression; and (c) identifying a modulation of at least one of the traits in the plants, relative to reference plants. In some embodiments, the purified bacterial population comprises 2-6 different seed bacterial endophytes. In some embodiments, the one or more seed bacterial endophytes are obtained from a plant cultivar different from the cultivar of the seeds in (a). In some embodiments, the seed bacterial endophytes are obtained from a surface sterilized seed. In some embodiments, the seed bacterial endophytes are obtained from surface sterilized seeds of a *Glycine max* variety, a *Glycine soja* accession, a *Zea mays* variety or hybrid, a Teosinte accession, a rice variety or hybrid, a wheat variety or hybrid, a barley variety or hybrid, or a cotton variety or hybrid. In some embodiments, the seeds of step (a) are seeds of a *Glycine max* variety, a *Zea mays* hybrid, a rice variety or hybrid, a wheat variety or hybrid, a barley variety or hybrid, or a cotton variety or hybrid.

Provided are methods for preparing an agricultural seed preparation, including: a) contacting the surface of a plurality of *Hordeum* agricultural plant seeds, e.g., *Hordeum vulgare* agricultural plant seeds, with a formulation including a purified bacterial population at a concentration of at least about $10^2$ CFU/ml in a liquid formulation or about $10^2$ CFU/gm in a non-liquid formulation, the bacterial population including a seed bacterial endophyte exhibiting the ability to produce or induce in a *Hordeum* agricultural plant grown from the *Hordeum* agricultural plant seed an activity selected from production of an auxin, production of an antimicrobial, production of a siderophore, mineral phosphate solubilization, production of a cellulase, production of a chitinase, production of a xylanase, and production of acetoin, wherein the seed bacterial endophyte is present in the formulation in an amount capable of providing a benefit to the plant seeds or to agricultural plants derived from the plant seeds, wherein the formulation further comprises a stabilizer, a fungicide, a preservative, or a combination thereof; and b) packaging the contacted seeds in a container.

Also, the bacterial endophyte comprises the ability to induce in the *Hordeum* agricultural plant at least two activities selected from production of an auxin, production of an antimicrobial, production of a siderophore, mineral phosphate solubilization, production of a cellulase, production of a chitinase, production of a xylanase, and production of acetoin. Also the contacted seeds and/or the *Hordeum* agricultural plant grown therefrom comprises an increased production of a polypeptide and/or ii) a reduced production of a polypeptide compared to a reference *Hordeum* agricultural plant. In some embodiments, the contacted plant seed has least one activity selected from at least two phenotypes or activities selected from the group consisting of production of an auxin, production of an antimicrobial, production of a siderophore, mineral phosphate solubilization, production of a cellulase, production of a chitinase, production of a xylanase, and acetoin production, and ii) inducing in the *Hordeum* agricultural plant and/or the *Hordeum* agricultural plant seed the production of a polypeptide.

In another aspect, provided are methods of making an agricultural seed preparation, the method including: (a) contacting the surface of a plurality of Hordeum vulgare seeds with a formulation including a purified bacterial population at a concentration of at least about $10^2$ CFU/mL in a liquid formulation or about $10^2$ CFU/g in a non-liquid formulation, of a seed bacterial endophyte that exhibits at least one activity selected from the group consisting of: production of an auxin, production of an antimicrobial, production of a siderophore, mineral phosphate solubilization, production of a cellulase, production of a chitinase, production of a xylanase, and production of acetoin, and (b) packaging the contacted seeds in packaging material In some embodiments, the contacted seeds are shelf-stable at about 25 degrees C. for at least 6 months. In some embodiments, the seed bacterial endophyte exhibits at least two activities selected from the group consisting of: production of an auxin, production of an antimicrobial, production of a siderophore, mineral phosphate solubilization, production of a cellulase, production of a chitinase, production of a xylanase, and production of acetoin.

Also provided is a method for generating a synthetic agricultural preparation, including: a) contacting the surface of a plurality of Hordeum agricultural plant seeds with a agriculturally acceptable formulation including a bacterial culture at a concentration of at least about $10^2$ CFU/ml in a liquid formulation or a purified cultured bacterial population at a concentration of at least about $10^2$ CFU/gm in a non-liquid formulation, wherein the bacterial culture or bacterial population are capable of production of an auxin, production of an antimicrobial, production of a siderophore, mineral phosphate solubilization, production of a cellulase, production of a chitinase, production of a xylanase, or production of acetoin, in an agricultural plant grown from the plant seeds.

Also provided are methods for treating seedlings, the methods including: a) contacting foliage or the rhizosphere of a plurality of Hordeum agricultural plant seedlings with a formulation including a purified bacterial population at a concentration of at least about $10^2$ CFU/ml in a liquid formulation or about $10^2$ CFU/g in a non-liquid formulation, wherein a substantial component of the CFUs present in the formulation comprise a seed bacterial endophyte exhibiting the ability to induce in the Hordeum agricultural plant seedlings an activity selected from production of an auxin, production of an antimicrobial compound, production of a siderophore, mineral phosphate solubilization, production of a cellulase, production of a chitinase, production of a xylanase, and production of acetoin, and wherein the seed bacterial endophyte is capable of propagating in the seedlings to an amount sufficient to provide a benefit to the seedlings or to agricultural plants derived from the seedlings; and b) growing the contacted seedlings under conditions such that the bacterial endophytes are viably retained in the seedlings.

Also provided are methods for modulating a Hordeum plant trait including: a) applying to Hordeum vegetation or an area adjacent the vegetation, a formulation including a purified bacterial population at a concentration of at least about $10^2$ CFU/ml in a liquid formulation or about $10^2$ CFU/g in a non-liquid formulation including a seed bacterial endophyte exhibiting the ability to induce in the Hordeum vegetation an activity selected from production of an auxin, production of an antimicrobial compound, production of a siderophore, mineral phosphate solubilization, production of a cellulase, production of a chitinase, production of a xylanase, and production of acetoin, wherein the formulation is capable of providing a benefit to the vegetation, or to a crop produced from the vegetation.

Also provided is a method for modulating the soil environment of a Hordeum plant, including contacting a Hordeum plant or seed thereof with a purified bacterial population including a bacterial entity selected from Table 1 under conditions such that the Hordeum plant i) removes from the soil environment at least one soil compound, and/or ii) introduces into the soil environment at least one soil compound not detectably present in the soil environment of a Hordeum plant, not contacted with an effective amount of a purified bacterial population.

Also provided is a method for modulating a Hordeum plant trait including: applying a formulation to soil, the formulation including a purified bacterial population at a concentration of at least about $10^2$ CFU/g, including a bacterial endophyte exhibiting the ability to induce in a Hordeum agricultural plant present in the soil an activity selected from production of an auxin, production of an antimicrobial compound, production of a siderophore, mineral phosphate solubilization, production of a cellulase, production of a chitinase, production of a xylanase, and production of acetoin, wherein the formulation is capable of providing a benefit to seeds planted within the formulation-applied soil, or to a crop produced from the Hordeum plants grown in the soil. In some embodiments, the bacterial endophyte comprises a 16S nucleic acid sequence having at least 97% sequence identity to the 16S nucleic acid sequence of a bacterial endophyte selected from a genus provided in Table 1 or a family provided in Table 2. In some embodiments, the bacterial endophyte is derived or obtained from i) a rice, maize, wheat, soy, or barley seed, or ii) from an agricultural plant grown from the seed.

Also provided is a method of screening a modulator of a Hordeum trait, including: (a) applying a library of bacterial entities to a population of seeds of a Hordeum agricultural plant; (b) measuring a trait in seedlings or plants derived from the seeds, the trait selected from the group consisting of root biomass, root length, height, shoot length, leaf number, water use efficiency, overall biomass, yield, photosynthesis rate, tolerance to drought, heat tolerance, salt tolerance, resistance to nematode stress, resistance to a fungal pathogen, resistance to a bacterial pathogen, resistance to a viral pathogen, the level of a metabolite, and proteome expression; and (c) identifying at least one of the bacterial entities present in the library capable of modulating the trait, relative to reference seedlings or plants. In some embodiments, the library comprises at least about 10-100 bacteria of one or more species of bacterial endophytes. In some embodiments, the bacterial endophytes comprise seed bacterial endophytes.

Also provided is a method of identifying a modulator of a plant trait, including: (a) applying a bacterial population to seeds of a Hordeum agricultural plant, the population including bacteria of one or more species of bacterial endophytes; (b) measuring a trait in seedlings or plants derived from the seeds, the trait selected from the group consisting of root biomass, root length, height, shoot length, leaf number, water use efficiency, overall biomass, yield, photosynthesis rate, tolerance to drought, heat tolerance, salt tolerance, resistance to nematode stress, resistance to a fungal pathogen, resistance to a bacterial pathogen, resistance to a viral pathogen, the level of a metabolite, and proteome expression; and (c) identifying at least one of the traits for which the bacterial population results in a modulation of the trait, relative to reference seedlings or plants. In some embodiments, the bacterial endophytes comprise a plurality of seed bacterial endophyte entities.

In another aspect, provided are synthetic combinations including a purified bacterial population in association with a plurality of seeds or seedlings of a *Hordeum* agricultural plant, wherein the purified bacterial population comprises a bacterial endophyte capable of at least one of: production of an auxin, production of an antimicrobial, production of a siderophore, mineral phosphate solubilization, production of a cellulase, production of a chitinase, production of a xylanase, and production of acetoin, or a combination of two or more thereof, and wherein the seed bacterial endophyte is present in the synthetic combination in an amount effective to provide a benefit to the seeds or seedlings or the plants derived from the *Hordeum* seeds or seedlings.

Also provided is an agricultural product including a 1000 seed weight amount of a synthetic combination produced by the step of contacting a plurality of *Hordeum vulgare* agricultural plant seeds with a liquid formulation including a bacterial population at a concentration of at least 1 CFU per agricultural plant seed, under conditions such that the formulation is associated with the surface of the seeds in a manner effective for the bacterial endophytes to confer a benefit to the seeds or to a crop including a plurality of agricultural plants produced from the seeds.

Also provided is a synthetic combination including a purified bacterial population in association with a plurality of seeds or seedlings of a *Hordeum* agricultural plant, wherein the purified bacterial population is capable of providing a benefit selected from the group consisting of: increased root biomass, increased root length, increased height, increased shoot length, increased leaf number, increased water use efficiency, increased overall biomass, increase yield, increased photosynthesis rate, increased tolerance to drought, increased heat tolerance, increased salt tolerance, increased resistance to nematode stress, increased resistance to a fungal pathogen, increased resistance to a bacterial pathogen, increased resistance to a viral pathogen, a detectable modulation in the level of a metabolite, and a detectable modulation in the proteome relative to a reference plant, or a combination thereof.

Also provided is an article of manufacture, including: (a) packaging material; (b) *Hordeum* plant seeds within the packaging material, and (c) at least one species of bacterial endophyte associated with the seeds.

Also provided is a synthetic combination including a purified bacterial population in association with a plurality of seeds or seedlings of a *Hordeum* agricultural plant, wherein the purified bacterial population comprises a first bacterial endophyte entity and a second bacterial endophyte entity, wherein the first and second bacterial endophyte entities are not identical. In some embodiments, the first and second bacterial endophyte entities synergistically induce in the *Hordeum* agricultural plant at least one trait selected from the group consisting of root biomass, root length, height, shoot length, leaf number, water use efficiency, overall biomass, yield, photosynthesis rate, tolerance to drought, heat tolerance, salt tolerance, resistance to nematode stress, resistance to a fungal pathogen, resistance to a bacterial pathogen, resistance to a viral pathogen, the level of a metabolite, and proteome expression. In some embodiments, the first and second bacterial endophyte entities synergistically induce in the *Hordeum* agricultural plant at least one activity selected from production of an auxin, production of an antimicrobial compound, production of a siderophore, mineral phosphate solubilization, production of a cellulase, production of a chitinase, production of a xylanase, and production of acetoin. In some embodiments, the first bacterial endophyte entity is derived or obtained from a first seed, and wherein the second bacterial endophyte entity is derived or obtained from a second seed. In some embodiments, the first and second bacterial endophyte entities are independently capable of forming spores. In some embodiments, the first and second bacterial endophyte entities synergistically colonize a first tissue of the *Hordeum* agricultural plant.

Also provided is a synthetic combination including a purified bacterial population in association with a plurality of seeds or seedlings of a *Hordeum vulgare* plant, wherein the purified bacterial population comprises a bacterial endophyte that exhibits at least one (e.g., at least two) activity selected from the group consisting of: production of an auxin, production of an antimicrobial, production of a siderophore, mineral phosphate solubilization, production of a cellulase, production of a chitinase, production of a xylanase, and production of acetoin, and wherein the seed bacterial endophyte is present in the synthetic combination in an amount effective to provide a trait to a similar *Hordeum vulgare* seed, seedling, or plant. In some embodiments, the bacterial endophyte is a seed bacterial endophyte. In some embodiments, the synthetic combination is disposed within a packaging material selected from a bag, box, bin, envelope, carton, or container. In some embodiments, the combination includes 1000 seed weight amount of seeds, wherein the packaging material optionally further comprises a dessicant, and wherein the synthetic combination optionally further comprises an anti-fungal agent. In some embodiments, the purified bacterial population comprises a first seed bacterial endophyte having a first 16S nucleic acid sequence and a second seed bacterial endophyte having a second 16S nucleic acid sequence, wherein the first and the second 16S nucleic acid sequences are less than 97% identical (e.g., 90-96%, 90-97%, 90%, 91%, 92%, 93%, 94%, 95%, or 96% identical).

In another aspect, the invention features a method for treating seeds. The method includes contacting the surface of a plurality of Poaceae agricultural plant seeds with a formulation including a purified bacterial population at a concentration of at least about $10^2$ CFU/ml in a liquid formulation or about $10^2$ CFU/gm in a non-liquid formulation, where at least 10% of the CFUs present in the formulation comprise a preferred seed bacterial endophyte, which exhibits: production of an auxin, nitrogen fixation, production of an antimicrobial, production of a siderophore, mineral phosphate solubilization, production of a cellulase, production of a chitinase, production of a xylanase, or production of acetoin, wherein the seed bacterial endophyte is present in the formulation in an amount capable of providing a benefit to the plant seeds or to agricultural plants derived from the plant seeds; and packaging the contacted seeds in a container. The method can further include drying the contacted seed. The contacting can include spraying, immersing, coating, encapsulating, or dusting the seeds or seedlings with the formulation.

The invention also features a method for treating seedlings. The method includes contacting foliage or the rhizosphere of a plurality of Poaceae agricultural plant seedlings with a formulation including a purified bacterial population at a concentration of at least about $10^2$ CFU/ml in a liquid formulation or about $10^2$ CFU/g in a non-liquid formulation, wherein at least 10% of the CFUs present in the formulation comprise a seed bacterial endophyte exhibiting production of an auxin, nitrogen fixation, production of an antimicrobial compound, production of a siderophore, mineral phosphate solubilization, production of a cellulase, production of a chitinase, production of a xylanase, or production of acetoin, and wherein the seed bacterial endophyte is present in the formulation in an amount capable of providing a benefit to the seedlings or to agricultural plants derived from the seedlings; and growing the contacted seedlings. The contacting can include spraying, immersing, coating, encapsulating, or dusting the seeds or seedlings with the formulation.

In another aspect, a method for modulating a Poaceae plant trait is featured. The method includes applying to vegetation (e.g., corn, wheat, rice, or barley seedlings) or an area adjacent the vegetation, a formulation that includes a purified bacterial population at a concentration of at least about $10^2$ CFU/ml in a liquid formulation or about $10^2$ CFU/g in a non-liquid formulation, at least 10% of the CFUs present in the formulation including a seed bacterial endophyte exhibiting: production of an auxin, nitrogen fixation, production of an antimicrobial compound, production of a siderophore, mineral phosphate solubilization, production of a cellulase, production of a chitinase, production of a xylanase, or production of acetoin, and combinations of two or more thereof, wherein the formulation is capable of providing a benefit to the vegetation, or to a crop produced from the vegetation.

A method for modulating a Poaceae plant trait is featured that includes applying a formulation to soil, the formulation including a purified bacterial population at a concentration of at least about $10^2$ CFU/g, at least 10% of the CFUs present in the formulation including a seed bacterial endophyte exhibiting: production of an auxin, nitrogen fixation, production of an antimicrobial compound, production of a siderophore, mineral phosphate solubilization, production of a cellulase, production of a chitinase, production of a xylanase, or production of acetoin, and combinations of two or more thereof, wherein the formulation is capable of providing a benefit to seeds planted within the soil, or to a crop produced from plants grown in the soil.

A method of making an article of manufacture also is featured. The method includes applying an agricultural formulation to Poaceae plant seeds, the formulation including a purified bacterial population and an agriculturally acceptable carrier, the bacterial population consisting essentially of a seed bacterial endophyte that exhibits: production of an auxin, nitrogen fixation, production of an antimicrobial, production of a siderophore, mineral phosphate solubilization, production of a cellulase, production of a chitinase, production of a xylanase, or production of acetoin, or combinations of two or more thereof; and packaging the coated seeds in packaging material.

The invention also features a method of identifying a modulator of a plant trait. The method includes applying a bacterial population to seeds of an agricultural plant, the population including bacteria of one or more species of seed bacterial endophytes; measuring a trait in seedlings or plants derived from the seeds, the trait selected from the group consisting of root biomass, root length, height, shoot length, leaf number, water use efficiency, overall biomass, yield (or grain yield), photosynthesis rate, tolerance to drought, heat tolerance, salt tolerance, resistance to nematode stress, resistance to a fungal pathogen, resistance to a bacterial pathogen, resistance to a viral pathogen, the level of a metabolite, and proteome expression; and identifying at least one of the traits for which the bacterial population results in a modulation of the trait, relative to reference seedlings or plants.

In another aspect, a method of identifying a modulator of a plant trait is featured. The method includes applying a bacterial population to seedlings of an agricultural plant, the population including bacteria of one or more species of seed bacterial endophytes; measuring a trait in the seedlings or in plants derived from the seedlings, the trait selected from the group consisting of root biomass, root length, height, shoot length, leaf number, water use efficiency, overall biomass, yield (or grain yield), photosynthesis rate, tolerance to drought, heat tolerance, salt tolerance, resistance to nematode stress, resistance to a fungal pathogen, resistance to a bacterial pathogen, resistance to a viral pathogen; the level of a metabolite, and proteome expression; and identifying at least one of the traits for which the bacterial population results in a modulation of the trait, relative to reference seedlings or plants. The modulation can be an increase in root biomass, an increase in root length, an increase in height, an increase in shoot length, an increase in leaf number, an increase in water use efficiency, an increase in overall biomass, an increase in yield (or grain yield), an increase in photosynthesis rate, an increase in tolerance to drought, an increase in heat tolerance, an increase in salt tolerance, an increase in resistance to nematode stress, an increase in resistance to a fungal pathogen, an increase in resistance to a bacterial pathogen, an increase in resistance to a viral pathogen, a detectable modulation in the level of a metabolite, or a detectable modulation in the proteome.

This invention also features a method for treating a cereal seed or seedling. The method includes contacting the exterior surface of a cereal seed or seedling with a formulation including a purified bacterial population, the purified bacterial population including at a level of at least 10% of the CFUs present in the formulation a seed bacterial endophyte capable of at least one of: production of an auxin, nitrogen fixation, production of an antimicrobial, production of a siderophore, mineral phosphate solubilization, production of a cellulase, production of a chitinase, production of a xylanase, or acetoin production, or a combination of two or more, under conditions such that the formulation becomes disposed upon an exterior surface of the cereal seed or seedling in a manner effective for the seed bacterial endophyte to provide a benefit to the cereal seed or seedling or to a cereal agricultural plant derived from the seed or seedling, and wherein the seed bacterial endophyte is capable of host colonization and/or replication within a tissue of the cereal agricultural plant; and packaging the contacted cereal seed or seedling in a container. In embodiments in which the cereal seed is contacted, the method further can include drying the contacted cereal seed. In embodiments in which the cereal seed is contacted, the seed bacterial endophyte can be present at a concentration of at least 1 CFU/seed on the surface of the contacted cereal seed. Contacting can include spraying, immersing, coating, dusting, or dipping the cereal seed or seedling with the formulation. The seed bacterial endophyte can be obtained or obtainable from an interior seed compartment, e.g., the seed bacterial endophyte can be obtained or obtainable from an interior seed compartment of a heterologous seed or seedling to the contacted cereal seed or seedling, or can be obtained or obtainable from an exterior surface of a heterologous seed or seedling to the contacted cereal seed or seedling. The seed bacterial endophyte can be heterologous to the microbial population within the contacted cereal seed or seedling. The seed bacterial endophyte can be obtained or obtainable from the interior seed compartment of a different cultivar, variety or crop as compared to the seed or seedling. The seed bacterial endophyte can be obtained or obtainable from an exterior surface of a different cultivar, variety or crop as compared to the seed or seedling. The benefit can be heritable by progeny of the agricultural cereal plant derived from the contacted cereal seed or seedling. The seed bacterial endophyte can include a 16S nucleic acid sequence at least 97% identical to a 16S nucleic acid sequence of a bacterial endophyte set forth in Table 1. The seed bacterial endophyte can be obtained or obtainable from the seed of a rice, maize, wheat, or barley plant. The seed bacterial endophyte can be capable of at least two of: production of an auxin, nitrogen fixation, production of an antimicrobial, production of a siderophore, mineral phosphate solubilization, production of a cellulase, production of a chitinase, production of a xylanase, and acetoin production.

A method for improving a plant trait in a cereal agricultural plant grown in a soil region also is featured. The method includes contacting at least a portion of the soil region with a formulation including a purified bacterial population, the purified bacterial population including at a level of at least 10% of the CFUs present in the formulation a seed bacterial endophyte capable of at least one of: production of an auxin, nitrogen fixation, production of an antimicrobial, production of a siderophore, mineral phosphate solubilization, production of a cellulase, production of a chitinase, production of a xylanase, and acetoin production, or a combination of two or more, under conditions such that the seed bacterial endophyte is capable of providing a benefit to a cereal seed or seedling planted within the soil region, or to an agricultural cereal plant derived from the cereal seed or seedling. The method can include planting a cereal seed or seedling in the soil region. The seed bacterial endophyte can be obtained or obtainable from an interior seed compartment, e.g., the seed bacterial endophyte can be obtained or obtainable from an interior seed compartment of a heterologous seed or seedling to the contacted cereal seed or seedling, or can be obtained or obtainable from an exterior surface of a heterologous seed or seedling to the contacted cereal seed or seedling. The seed bacterial endophyte can be exogenous to the microbial population within the contacted cereal seed or seedling.

The invention also features a method for planting a field region with an agricultural cereal crop. The method includes obtaining a container including at least 10 synthetic combinations, wherein each synthetic combination comprises a purified bacterial population in association with a cereal seed or seedling, wherein the purified bacterial population comprises a seed bacterial endophyte capable of at least one of: production of an auxin, nitrogen fixation, production of an antimicrobial, production of a siderophore, mineral phosphate solubilization, production of a cellulase, production of a chitinase, production of a xylanase, or acetoin production, or combinations of two or more thereof, and wherein the seed bacterial endophyte is present in an amount effective to provide a benefit to the cereal seed or seedling or the agricultural cereal plant derived from the cereal seed or seedling; and distributing the synthetic combinations from the container in the field region. In any of the methods, the seed bacterial endophyte can be obtained or obtainable from an interior seed compartment, e.g., the seed bacterial endophyte can be obtained or obtainable from an interior seed compartment of a heterologous seed or seedling to the contacted cereal seed or seedling, or can be obtained or obtainable from an exterior surface of a heterologous seed or seedling to the contacted cereal seed or seedling. The seed bacterial endophyte can be exogenous to the microbial population within the contacted cereal seed or seedling.

In any of the methods, compositions, synthetic combinations, preparations, agricultural products, agricultural formulations or articles described herein, the seed bacterial endophyte can be present at a concentration of at least $10^2$ CFU/seed on the surface of the seeds after contacting.

In any of the methods, compositions, synthetic combinations, preparations, agricultural products, agricultural formulations or articles described herein, the seed bacterial endophyte can be obtained from an interior seed compartment (e.g., cotyledon, plumule, embryo, or endosperm).

In any of the methods, compositions, synthetic combinations, preparations, agricultural products, agricultural formulations or articles described herein, the seed bacterial endophyte can be obtained from a plant species other than the seeds with which the formulation is contacted.

In any of the methods, compositions, synthetic combinations, preparations, agricultural products, agricultural formulations or articles described herein, the seed bacterial endophyte can be obtained from a plant cultivar different from the cultivar of the seeds with which the formulation is contacted.

In any of the methods, compositions, synthetic combinations, preparations, agricultural products, agricultural formulations or articles described herein, the seed bacterial endophyte can be obtained from a surface sterilized seed.

In any of the methods, compositions, synthetic combinations, preparations, agricultural products, agricultural formulations or articles described herein, the benefit can be maternally inherited by progeny of the contacted plant seeds.

In any of the methods, compositions, synthetic combinations, preparations, agricultural products, agricultural formulations or articles described herein, the benefit can be paternally inherited by progeny of the contacted plant seeds.

In any of the methods, compositions, synthetic combinations, preparations, agricultural products, agricultural formulations or articles described herein, the seed bacterial endophyte can include a 16S nucleic acid sequence having at least 97% sequence identity to a 16S nucleic acid sequence of a bacterial endophyte selected from a genus provided in Table 1 or a family provided in Table 2.

In any of the methods, compositions, synthetic combinations, preparations, agricultural products, agricultural formulations or articles described herein, the seed bacterial endophyte can include a 16S nucleic acid sequence that is less than 97% (e.g., 90-96%, 90-97%, 90%, 91%, 92%, 93%, 94%, 95%, or 96%) identical to any 16S nucleic acid sequence shown in Table 1.

In any of the methods, compositions, synthetic combinations, preparations, agricultural products, agricultural formulations or articles described herein, the bacterial population can include a first seed bacterial endophyte having a first 16S nucleic acid sequence and a second seed bacterial endophyte having a second 16S nucleic acid sequence, wherein the first and the second 16S nucleic acid sequences are less than 97% identical (e.g., 90-96%, 90-97%, 90%, 91%, 92%, 93%, 94%, 95%, or 96% identical).

In any of the methods, compositions, synthetic combinations, preparations, agricultural products, agricultural formulations or articles described herein, the bacterial population can include two or more families of seed bacterial endophytes, or three or more families, or four or more families.

In any of the methods, compositions, synthetic combinations, preparations, agricultural products, agricultural formulations or articles described herein, the bacterial population can include two or more species of seed bacterial endophytes, or three or more species, or four or more species.

In any of the methods, compositions, synthetic combinations, preparations, agricultural products, agricultural formulations or articles described herein, the seed bacterial endophyte can be a non-*Bacillus* species and/or a non-*Pseudomonas* species.

In any of the methods, compositions, synthetic combinations, preparations, agricultural products, agricultural formulations or articles described herein, the seed bacterial endophyte can be obtained from a rice, maize, wheat, barley, or soy seed.

In any of the methods, compositions, synthetic combinations, preparations, agricultural products, agricultural formulations or articles described herein, the seed bacterial endophyte can exhibit at least two of: production of an auxin, nitrogen fixation, production of an antimicrobial, production of a siderophore, mineral phosphate solubilization, production of a cellulase, production of a chitinase, production of a xylanase, or production of acetoin, or combinations thereof. In some embodiments, the seed bacterial endophyte can exhibit at least three, at least four, or at least five of production of an auxin, nitrogen fixation, production of an antimicrobial, production of a siderophore, mineral phosphate solubilization, production of a cellulase, production of a chitinase, production of a xylanase, or production of acetoin.

In any of the methods, compositions, synthetic combinations, preparations, agricultural products, agricultural formulations or articles described herein, the benefit can be selected from the group consisting of: increased root biomass, increased root length, increased height, increased shoot length, increased leaf number, increased water use efficiency, increased overall biomass, increase yield (or grain yield), increased photosynthesis rate, increased tolerance to drought, increased heat tolerance, increased salt tolerance, increased resistance to nematode stress, increased resistance to a fungal pathogen, increased resistance to a bacterial pathogen, increased resistance to a viral pathogen, a detectable modulation in the level of a metabolite, and a detectable modulation in the proteome, relative to reference seeds or agricultural plants derived from reference seeds. The benefit can include a combination of at least two of such benefits, at least three such benefits, at least four such benefits, or at least five such benefits.

In another aspect, the invention features a synthetic combination that includes a purified bacterial population in association with a plurality of seeds or seedlings of a Poaceae agricultural plant, wherein the purified bacterial population comprises a seed bacterial endophyte capable of at least one of: production of an auxin, nitrogen fixation, production of an antimicrobial, production of a siderophore, mineral phosphate solubilization, production of a cellulase, production of a chitinase, production of a xylanase, or production of acetoin, or a combination of two or more thereof, and wherein the seed bacterial endophyte is present in the synthetic combination in an amount effective to provide a benefit to the seeds or seedlings or the plants derived from the seeds or seedlings. For example, the effective amount can be $1\times10^3$ CFU/per seed or from about $1\times10^2$ CFU/seed to about $1\times10^8$ CFU/seed. The benefit can be heritable by progeny of plants derived from the seeds or seedlings. The benefit can be selected from the group consisting of increased root biomass, increased root length, increased height, increased shoot length, increased leaf number, increased water use efficiency, increased overall biomass, increase yield (or grain yield), increased photosynthesis rate, increased tolerance to drought, increased heat tolerance, increased salt tolerance, increased resistance to nematode stress, increased resistance to a fungal pathogen, increased resistance to a bacterial pathogen, increased resistance to a viral pathogen, a detectable modulation in the level of a metabolite, and a detectable modulation in the proteome relative to a reference plant, and combinations of two or more thereof. The synthetic combination further can include one or more additional seed bacterial endophyte species. The synthetic combination can include seeds and the seed bacterial endophyte can be associated with the seeds as a coating on the surface of the seeds (e.g., a substantially uniform coating on the seeds). The synthetic combination can include seedlings and the seed bacterial endophyte can be contacted with the seedlings as a spray applied to one or more leaves and/or one or more roots of the seedlings.

The synthetic combination can be disposed within a packaging material selected from a bag, box, bin, envelope, carton, or container. The synthetic combination can include 1000 seed weight amount of seeds, wherein the packaging material optionally comprises a desiccant, and wherein the synthetic combination optionally comprises an anti-fungal agent. The purified bacterial population can be localized on the surface of the seeds or seedlings. The seed bacterial endophyte can be obtained from an interior seed compartment.

In another aspect, the invention features an agricultural product that includes a 1000 seed weight amount of a synthetic combination produced by the step of contacting a plurality of Poaceae agricultural plant seeds with a liquid formulation including a bacterial population at a concentration of at least 1 CFU per agricultural plant seed, wherein at least 10% of the CFUs present in the formulation are one or more seed bacterial endophytes, under conditions such that the formulation is associated with the surface of the seeds in a manner effective for the seed bacterial endophytes to confer a benefit to the seeds or to a crop comprising a plurality of agricultural plants produced from the seeds. The seed bacterial endophytes can be present in a concentration of from about $10^2$ to about $10^5$ CFU/ml or from about $10^5$ to about $10^8$ CFU/seed. The formulation can be a liquid and the bacterial concentration can be from about $10^3$ to about $10^{11}$ CFU/ml. The formulation can be a gel or powder and the bacterial concentration can be from about $10^3$ to about $10^{11}$ CFU/gm.

The invention also features an agricultural formulation that includes a purified bacterial population and an agriculturally acceptable carrier, the bacterial population consisting essentially of a seed bacterial endophyte that exhibits: production of an auxin, nitrogen fixation, production of an antimicrobial, production of a siderophore, mineral phosphate solubilization, production of a cellulase, production of a chitinase, production of a xylanase, or production of acetoin, or combinations of two or more thereof, where the seed bacterial endophyte present in an amount effective to confer a benefit to a Poaceae agricultural plant seed to which the formulation is applied or to an agricultural plant seedling to which the formulation is applied. The seed bacterial endophyte can be obtained from a surface sterilized seed, from the surface of a seedling, or an unsterilized seed.

In yet another aspect, the invention features an article of manufacture that includes packaging material; Poaceae plant seeds within the packaging material, and at least one species of seed bacterial endophyte associated with the seeds. The article can include two or more species of seed bacterial endophytes.

A synthetic combination also is featured that includes a purified bacterial population in association with a seed or seedling of a cereal agricultural plant, wherein the purified bacterial population comprises a seed bacterial endophyte capable of at least one of: production of an auxin, nitrogen fixation, production of an antimicrobial, production of a siderophore, mineral phosphate solubilization, production of a cellulase, production of a chitinase, production of a xylanase, and acetoin production, or a combination of two or more thereof, wherein the seed bacterial endophyte is present in the synthetic combination in an amount effective to provide a benefit to the seed or seedling or the cereal agricultural plant derived from the seed or seedling. The synthetic combination can be disposed within a package and is shelf stable. The purified bacterial population can be localized on the surface of the seed or seedling. The seed bacterial endophyte can be present at a concentration of at least 1 CFU/seed on the surface of a seed. The seed bacterial endophyte can be obtained or can be obtainable from an interior seed compartment. The seed bacterial endophyte can be obtained or can be obtainable from an interior seed compartment of a heterologous seed or seedling. The seed bacterial endophyte can be obtained or can be obtainable from an exterior surface of a heterologous seed or seedling. The seed bacterial endophyte can be exogenous to the microbial population within the seed or seedling. The benefit can be heritable by progeny of the agricultural plant. The benefit can include at least two benefits, wherein the synthetic combination comprises two or more seed bacterial endophyte.

In another aspect, the invention features a synthetic combination of a purified bacterial population in association with a seed or seedling of a cereal agricultural plant, wherein the synthetic combination is produced by the step of contacting the seed or seedling with a formulation including a purified bacterial population, wherein the purified bacterial population comprises an effective amount of a seed bacterial endophyte capable of conferring a benefit on the contacted seed or seedling or cereal agricultural plant derived from the seed or seedling, the benefit selected from the group consisting of: increased root biomass, increased root length, increased height, increased shoot length, increased leaf number, increased water use efficiency, increased overall biomass, increase yield (or grain yield), increased photosynthesis rate, increased tolerance to drought, increased heat tolerance, increased salt tolerance, increased resistance to nematode stress, increased resistance to a fungal pathogen, increased resistance to a bacterial pathogen, increased resistance to a viral pathogen, a detectable modulation in the level of a metabolite, and a detectable modulation in the proteome relative to a reference plant, under conditions such that the formulation becomes disposed upon an exterior surface of the seed or seedling in a manner effective for the seed bacterial endophyte to provide the benefit to the seed or seedling or to the cereal agricultural plant derived from the seed or seedling, and wherein the seed bacterial endophyte is capable of host colonization and/or replication within a tissue of the cereal agricultural plant.

In yet another aspect, the invention features an agricultural formulation including a purified bacterial population consisting essentially of a seed bacterial endophyte capable of conferring on a seed, seedling, or agricultural plant a benefit selected from: increased tolerance to drought, increased heat tolerance, and increased salt tolerance, wherein the seed bacterial endophyte is present in an amount effective to provide the benefit to a seed or seedling to which the formulation is administered or to an agricultural plant derived from the seed or seedling to which the formulation is administered, and an agriculturally acceptable carrier. The seed bacterial endophyte is obtained or obtainable from an interior seed compartment. The seed bacterial endophyte can be obtained or obtainable from an exterior surface of a seed. The seed bacterial endophyte can be heterologous to the microbial population within the contacted cereal seed or seedling. The seed bacterial endophyte can be obtained or obtainable from the interior seed compartment of a different cultivar, variety or crop as compared to the seed or seedling. The seed bacterial endophyte can be obtained or obtainable from an exterior surface of a different cultivar, variety or crop as compared to the seed or seedling. The seed bacterial endophyte is capable of: production of an auxin, nitrogen fixation, production of an antimicrobial, production of a siderophore, mineral phosphate solubilization, production of a cellulase, production of a chitinase, production of a xylanase, or acetoin production, or a combination of two or more thereof. The seed bacterial endophyte can be capable of generating a bacterial network in the agricultural plant derived from the seed or seedling or in the seed or seedling to which the formulation is administered, or in the surrounding environment of the plant, seed, or seedling, and wherein the bacterial network is capable of causing a detectable modulation in the level of a metabolite in the seed, seedling, or plant or a detectable modulation in the proteome of the agricultural plant derived from the seed or seedling. The purified bacterial population can consist essentially of two seed bacterial endophytes.

In any of the methods, synthetic combinations, agricultural products, agricultural formulations, or articles of manufacture, the purified bacterial population can consist essentially of two or more species of seed bacterial endophytes. The purified bacterial population can consist essentially of seed bacterial endophytes having a 16S nucleic acid sequence at least 97% identical to a bacterial endophyte selected from a genus shown in Table 1 or from a family shown in Table 2. The purified bacterial population can consist essentially of a synergistic combination of two seed bacterial endophytes. The bacterial population can be shelf-stable. The benefit can be selected from the group consisting of: increased root biomass, increased root length, increased height, increased shoot length, increased leaf number, increased water use efficiency, increased overall biomass, increase grain yield, increased photosynthesis rate, increased tolerance to drought, increased heat tolerance, increased salt tolerance, increased resistance to nematode stress, increased resistance to a fungal pathogen, increased resistance to a bacterial pathogen, increased resistance to a viral pathogen, a detectable modulation in the level of a metabolite, and a detectable modulation in the proteome relative to a reference plant, or a combination of two or more thereof.

In any of the methods, synthetic combinations, agricultural products, agricultural formulations, or articles of manufacture, the seed bacterial endophyte can be a non-spore forming bacterial species. The seed bacterial endophyte can exhibit: production of auxin, production of an antimicrobial, production of a siderophore, production of a cellulase, production of a chitinase, production of a xylanase, or production of acetoin, or combinations thereof. The seed bacterial endophyte can exhibit: production of auxin, production of a siderophore, mineral phosphate solubilization, production of a cellulase, production of a chitinase, production of a xylanase, or production of acetoin, but does not increase nitrogen fixation relative to a reference plant. The seed bacterial endophyte can be shelf-stable. The seed bacterial endophyte can be a non-*Bacillus* species and/or a non-*Pseudomonas* species.

In any of the methods, synthetic combinations, agricultural products, agricultural formulations, or articles of manufacture, the seed bacterial endophyte can be obtained from a plant species other than the seeds or seedlings of the synthetic combination. The seed bacterial endophyte can be obtained from a plant cultivar different from the cultivar of the seeds or seedlings of the synthetic combination. The seed bacterial endophyte can be obtained from a plant cultivar that is the same as the cultivar of the seeds or seedlings of the synthetic combination. The seed bacterial endophyte can be obtained from an exterior surface of a heterologous seed or seedling.

In any of the methods, synthetic combinations, agricultural products, agricultural formulations, or articles of manufacture, the bacterial population can include a seed bacterial endophyte having a 16S nucleic acid sequence that is less than 97% identical (e.g., 90-96%, 90-97%, 90%, 91%, 92%, 93%, 94%, 95%, or 96% identical) to any 16S nucleic acid sequence shown in Table 1. The bacterial population can include a seed bacterial endophyte having a 16S nucleic acid sequence that is at least 97% identical to a 16S nucleic acid sequence shown in Table 1. The bacterial population can include two or more families of seed bacterial endophytes. The bacterial population can include a first seed bacterial endophyte having a first 16S nucleic acid sequence and a second seed bacterial endophyte having a second 16S nucleic acid sequence, wherein the first and the second 16S nucleic acid sequences are less than 97% identical (e.g., 90-96%, 90-97%, 90%, 91%, 92%, 93%, 94%, 95%, or 96% identical).

In any of the methods, synthetic combinations, agricultural products, agricultural formulations, or articles of manufacture, the bacterial population can include a first seed bacterial endophyte and a second seed bacterial endophyte, wherein the first and second seed bacterial endophytes are independently capable of at least one of production of an auxin, nitrogen fixation, production of an antimicrobial, production of a siderophore, mineral phosphate solubilization, production of a cellulase, production of a chitinase, production of a xylanase, or production of acetoin, or a combination of two or more thereof.

In any of the methods, synthetic combinations, agricultural products, agricultural formulations, or articles of manufacture, the bacterial population can include a first seed bacterial endophyte and a second seed bacterial endophyte, wherein the first and second seed bacterial endophytes are capable of synergistically increasing at least one of: production of an auxin, nitrogen fixation, production of an antimicrobial, production of a siderophore, mineral phosphate solubilization, production of a cellulase, production of a chitinase, production of a xylanase, or production of acetoin, or a combination of two or more thereof, in an amount effective to increase tolerance to drought relative to a reference plant.

In any of the methods, synthetic combinations, agricultural products, agricultural formulations, or articles of manufacture, the bacterial population can include a first seed bacterial endophyte and a second seed bacterial endophyte, wherein the first and second seed bacterial endophytes are obtained from the same cultivar. The bacterial population can include a first seed bacterial endophyte and a second seed bacterial endophyte, wherein the first and second seed bacterial endophytes are obtained from different cultivars of the same agricultural plant.

In any of the methods, synthetic combinations, agricultural products, agricultural formulations, or articles of manufacture, the bacterial population can include a first seed bacterial endophyte and a second seed bacterial endophyte, wherein the first seed bacterial endophyte is capable of colonizing a first agricultural plant tissue and wherein the second seed bacterial endophyte is capable of colonizing a second agricultural plant tissue not identical to the first agricultural plant tissue.

In any of the methods, synthetic combinations, agricultural products, agricultural formulations, or articles of manufacture, the seed bacterial endophyte can be obtained or can be obtainable from a barley, rice, maize, wheat, or soy seed. For example, the seed bacterial endophyte can be obtained or can be obtainable from an interior compartment of a corn, wheat, or barley seed. The seed bacterial endophyte can be a non-spore forming bacterial species. The seed bacterial endophyte can be a non-*Bacillus* species and/or a non-*Pseudomonas* species.

In any of the methods, the synthetic combinations, agricultural products, agricultural formulations, or articles of manufacture, the seed bacterial endophyte can exhibit production of auxin, production of an antimicrobial, production of a siderophore, production of a cellulase, production of a chitinase, production of a xylanase, or production of acetoin, or combinations of two or more thereof. The seed bacterial endophyte can be shelf-stable.

In any of the methods, synthetic combinations, agricultural products, agricultural formulations, or articles of manufacture, the seed bacterial endophyte can exhibit production of auxin, production of a siderophore, mineral phosphate solubilization, production of a cellulase, production of a chitinase, production of a xylanase, or production of acetoin, or combinations of two or more thereof, but does not increase nitrogen fixation relative to a reference plant.

In any of the methods, synthetic combinations, agricultural products, agricultural formulations, or articles of manufacture, the bacterial population can include two or more families (e.g., three or more, four or more, five or more) of seed bacterial endophytes or two or more (e.g., three or more, four or more, five or more) seed bacterial endophyte species.

In any of the methods, synthetic combinations, agricultural products, agricultural formulations, or articles of manufacture, the seed bacterial endophyte can be a non-*Bacillus* species and/or a non-*Pseudomonas* species.

Unless otherwise defined, all technical and scientific terms used herein have the same meaning as commonly understood by one of ordinary skill in the art to which this invention pertains. Although methods and materials similar or equivalent to those described herein can be used to practice the invention, suitable methods and materials are described below. All publications, patent applications, patents, and other references mentioned herein are incorporated by reference in their entirety. In case of conflict, the present specification, including definitions, will control. In addition, the materials, methods, and examples are illustrative only and not intended to be limiting.

The details of one or more embodiments of the invention are set forth in the accompanying drawings and the description below. Other features, objects, and advantages of the invention will be apparent from the description and drawings, and from the claims. The word "comprising" in the claims may be replaced by "consisting essentially of" or with "consisting of," according to standard practice in patent law.

DEFINITIONS

Figure 1A:
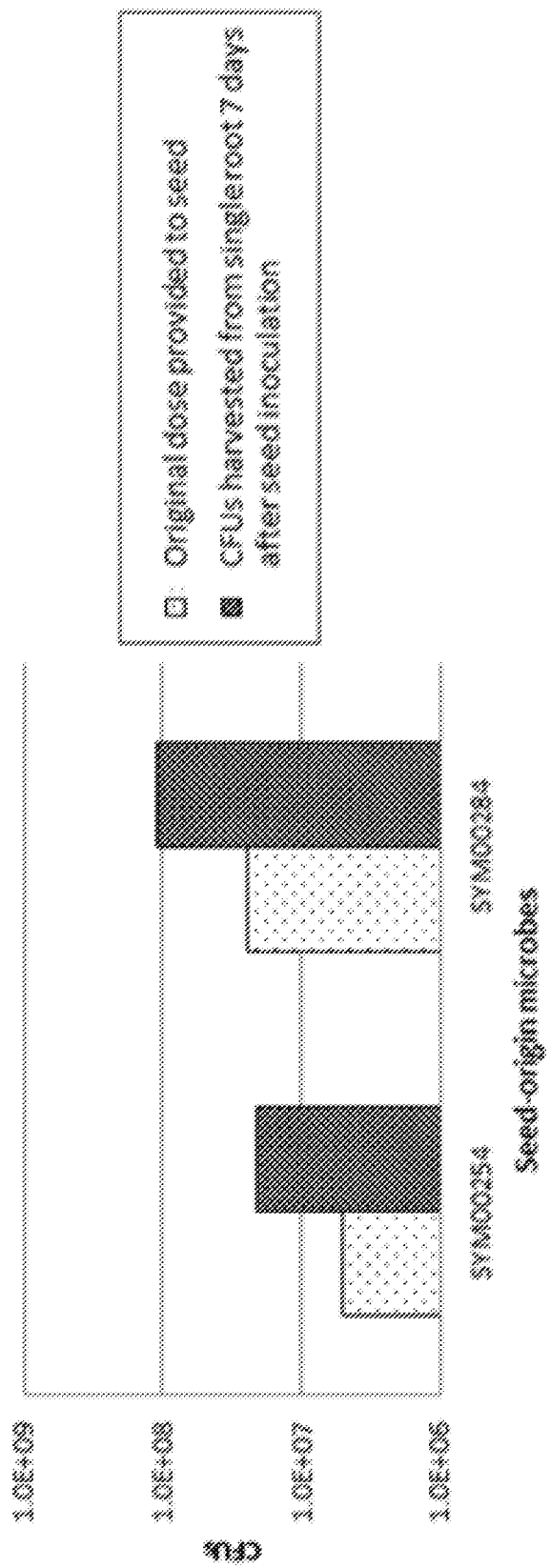
FIG. 1A is a graph of the number of CFUs per root after bacterial seed endophytes SYM00254 and SYM00284 were coated on the outside of surface sterilized corn seeds, and the seeds planted in axenic conditions and incubated for 7 days to germinate. The dose delivered to the seed surface was quantified by serial dilution and plating of liquid inoculum, while the microbial population colonizing roots after 7 days of incubation was quantified by macerating roots, serial dilution, plating and colony counting to obtain CFU per root.

An "endophyte" or "endophytic microbe" is an organism that lives within a plant or is otherwise associated therewith. Endophytes can occupy the intracellular or extracellular spaces of plant tissue, including the leaves, stems, flowers, fruits, seeds, and/or roots. An endophyte can be either a bacterial or a fungal organism that can confer one or more beneficial properties, benefits, or traits to a plant such as an increase in yield, biomass, resistance, or fitness or combinations thereof in its host plant. As used herein, the term "microbe" is sometimes used to describe an endophyte.

In some embodiments, a bacterial endophyte is a seed bacterial endophyte. As used herein, the terms "seed bacterial endophyte" and "seed-origin bacterial endophyte" are used interchangeably and each refers to a population of bacteria associated with or derived from the seed of a grass or *Glycine* plant. For example, a seed bacterial endophyte can be found in mature, dry, undamaged (e.g., no cracks, visible fungal infection, or prematurely germinated) seeds. The seed bacterial endophyte can be associated with or derived from the surface of the seed; alternatively, or in addition, it can be associated with or derived from the interior seed compartment (e.g., of a surface-sterilized seed). In some cases, a seed bacterial endophyte is capable of replicating within the plant tissue, for example, the interior of the seed. Also, in some cases, the seed bacterial endophyte is capable of surviving desiccation.

A seed bacterial entity or a seed-origin bacterial entity means that the bacterial entity is obtained directly or indirectly from a seed surface or seed interior compartment or is obtainable from a seed surface or seed interior compartment. For example, a seed bacterial entity can be obtained directly or indirectly from a seed surface or seed interior compartment when it is isolated, or isolated and purified, from a seed preparation; in some cases, the seed bacterial entity which has been isolated, or isolated and purified, may be cultured under appropriate conditions to produce a purified bacterial population that includes at least about $10^2$ CFU/mL (e.g., $10^3$, $10^4$, $10^5$, $10^6$, $10^7$, $10^8$, $10^9$, $10^{10}$, or more CFU/mL) of a seed bacterial endophyte in a liquid formulation or $10^2$ CFU/g (e.g., $10^3$, $10^4$, $10^5$, $10^6$, $10^7$, $10^8$, $10^9$, $10^{10}$, or more CFU/g) of a seed bacterial endophyte in a non-liquid formulation. A final product may contain up to about 10%, about 20%, about 30%, about 40%, about 50%, about 60%, about 70%, about 80%, about 90%, about 95%, about 99%, about 99.9%, or above about 99.9% other materials and still be considered to contain a purified bacterial population. In some embodiments, a purified bacterial population consists essentially of a seed bacterial endophyte. A seed bacterial endophyte can be considered to be obtainable from a seed surface or seed interior compartment if the bacteria can be detected on or in, or isolated from, a seed surface or seed interior compartment of a plant.

The compositions provided herein are preferably stable. The seed bacterial endophyte is optionally shelf-stable, where at least 10% of the CFUs are viable after storage in desiccated form (i.e., moisture content of 30% or less) for 1, 2, 3, 4, 5, 6, 7, 8, 9, 10 or greater than 10 weeks at 4° C. or at room temperature (about 25° C.). Optionally, a shelf stable formulation is in a dry formulation, a powder formulation, or a lyophilized formulation. In some embodiments, the formulation is formulated to provide stability for the population of seed bacterial endophytes. In one embodiment, the formulation is substantially stable (meaning at least about 5% viability, e.g., 10, 15, 20, 25, 30, 35, 40, 45, 50, 55, 60, 65, 70, 75, 80, 85, 90, 95, 96, 97, 98, 99, 99.9 or greater than 99.9% viable) at temperatures between about 0° C. and about 50° C. for at least about 1, 2, 3, 4, 5, or 6 days, or 1, 2, 3 or 4 weeks, or 1, 2, 3, 4, 5, 6, 7, 8, 9, 10, 11 or 12 months, or one or more years. In another embodiment, the formulation is substantially stable at temperatures between about 4° C. and about 37° C. for at least about 5, 10, 15, 20, 25, 30 or greater than 30 days.

Agricultural seed preparations, seed treatments, or synthetic combinations of seeds of an agricultural plant associated with a seed bacterial endophyte also can be shelf stable. For example, an agricultural seed preparation, seed treatment, or synthetic combination can be shelf-stable at temperatures between about 4° C. and about 37° C. for at least about 5, 10, 15, 20, 25, 30 or greater than 30 days; 1, 2, 3 4, or more weeks; or 1, 2, 3, 4, 5, 6, 7, 8, 9, 10, 11 or 12 months; or one or more years. In one embodiment, an agricultural seed preparation, seed treatment, or synthetic combination can be shelf-stable at 25° C. for 4 to 12 months (e.g., 4, 5, 6, 7, 8, 9, 10, 11, or 12 months).

An agricultural plant can be a monocotyledonous (i.e., an "agricultural grass plant") or a dicotyledonous plant (e.g., a *Glycine* plant such as *Glycine max*) typically used in agriculture. An agricultural grass plant includes, but is not limited to, maize (*Zea mays*), common wheat (*Triticum aestivum*), spelt (*Triticum spelta*), einkorn wheat (*Triticum monococcum*), emmer wheat (*Triticum dicoccum*), durum wheat (*Triticum durum*), Asian rice (*Oryza sativa*), African rice (*Oryza glabaerreima*), wild rice (*Zizania aquatica, Zizania latifolia, Zizania palustris, Zizania texana*), barley (*Hordeum vulgare*), Sorghum (*Sorghum bicolor*), Finger millet (*Eleusine coracana*), Proso millet (*Panicum miliaceum*), Pearl millet (*Pennisetum glaucum*), Foxtail millet (*Setaria italic*), Oat (*Avena sativa*), Triticale (*Triticosecale*), rye (*Secale cereal*), Russian wild rye (*Psathyrostachys juncea*), bamboo (*Bambuseae*), or sugarcane (e.g., *Saccharum arundinaceum, Saccharum barberi, Saccharum bengalense, Saccharum edule, Saccharum munja, Saccharum officinarum, Saccharum procerum, Saccharum ravennae, Saccharum robustum, Saccharum sinense,* or *Saccharum spontaneum*).

A "host plant" includes any plant, particularly an agricultural plant, which an endophytic microbe such as a seed bacterial endophyte can colonize. As used herein, a microbe (e.g., a seed bacterial endophyte) is said to "colonize" a plant or seed when it can be stably detected within the plant or seed over a period time, such as one or more days, weeks, months or years; in other words, a colonizing microbe is not transiently associated with the plant or seed. A preferred host plant is a cereal plant.

As used herein, a "reference agricultural plant" or a "reference plant" is an agricultural plant of the same species, strain, or cultivar to which a treatment, formulation, composition, purified bacterial population, or seed endophyte preparation as described herein is not administered/contacted to the plant or a seed or seedling used to generate the plant. Exemplary reference agricultural plants are cereals or soybean plants. A reference agricultural plant, therefore, is identical to the treated plant with the exception of the presence of the seed endophyte and can serve as a control for detecting the effects of the seed endophyte that is conferred to the plant.

As used herein, a "reference seed" is an agricultural seed of the same species, strain, or cultivar to which a treatment, formulation, composition, purified bacterial population, or a seed bacterial endophyte as described herein in not administered/contacted. A reference seed, therefore, is identical to the treated seed with the exception of the presence of the seed-origin bacterial endophyte and can serve as a control for detecting the effects of the seed bacterial endophyte that is conferred to the seed.

"Biomass" means the total mass or weight (fresh or dry), at a given time, of a plant tissue, plant tissues, an entire plant, or population of plants. Biomass is usually given as weight per unit area. The term may also refer to all the plants or species in the community (community biomass).

A "bacterial network" means a plurality of endophyte entities (e.g., bacteria, fungi, or combinations thereof) co-localized in an environment, such as on or within a cereal or *Glycine* agricultural plant (e.g., a *Glycine max* plant). Preferably, a bacterial network includes two or more types of endophyte entities that synergistically interact, such synergistic endophytic populations capable of providing a benefit to the agricultural seed, seedling, or plant derived thereby.

An "increased yield" can refer to any increase in biomass or seed or fruit weight, seed size, seed number per plant, seed number per unit area, bushels per acre, tons per acre, kilo per hectare, or carbohydrate yield. Typically, the particular characteristic is designated when referring to increased yield, e.g., increased yield (or grain yield) or increased seed size.

A "transgenic plant" includes a plant or progeny plant of any subsequent generation derived therefrom, wherein the DNA of the plant or progeny thereof contains an exogenous DNA not naturally present in a non-transgenic plant of the same species. The transgenic plant may additionally contain sequences that are native to the plant being transformed, but wherein the "exogenous" gene has been altered in order to alter the level or pattern of expression of the gene, for example, by use of one or more heterologous regulatory or other elements.

An exogenous nucleic acid (also can be referred to as a heterologous nucleic acid) such as an exogenous DNA refers to a nucleic acid sequence that is not naturally occurring in the plant seed, plant seedling, or a plant. The exogenous nucleic acid can include fragments of nucleic acids that are native to the plant seed, plant seedling, or plant, provided the nucleic acid as a whole does not exist in the plant seed, plant seedling, or plant. The heterologous nucleic acid can include a sequence that does not encode a protein (e.g., a promoter, enhancer, or other regulatory element, or an antisense or inhibitory nucleic acid). The heterologous nucleic acid can include a sequence that encodes a protein that is not naturally occurring in the plant seed, the plant seedling, or the plant.

The terms "pathogen" and "pathogenic" in reference to a bacterium includes any such organism that is capable of causing or affecting a disease, disorder or condition of a host containing the organism.

A "spore" or a population of "spores" refers to bacteria that are generally viable, more resistant to environmental influences such as heat and bacteriocidal agents than vegetative forms of the same bacteria, and are typically capable of germination and out-growth. Bacteria that are "capable of forming spores" are those bacteria containing the genes and other necessary abilities to produce spores under suitable environmental conditions.

As used herein, an "agricultural seed" is a seed used to grow a plant typically used in agriculture (an "agricultural plant"). The seed may be of a monocot or dicot plant, and may be planted for the production of an agricultural product, for example grain, food, fiber, etc. As used herein, an agricultural seed is a seed that is prepared for planting, for example, in farms for growing.

In some cases, the present invention contemplates the use of microbes (e.g., seed bacterial endophytes) that are "compatible" with agricultural chemicals, for example, a fungicide, an anti-bacterial compound, or any other agent widely used in agricultural which has the effect of killing or otherwise interfering with optimal growth of microbes. As used herein, a microbe such as a seed bacterial endophyte is "compatible" with an agricultural chemical when the microbe is modified, such as by genetic modification, e.g., contains a transgene that confers resistance to an herbicide, or is adapted to grow in, or otherwise survive, the concentration of the agricultural chemical used in agriculture. For example, a microbe disposed on the surface of a seed is compatible with the fungicide metalaxyl if it is able to survive the concentrations that are applied on the seed surface.

In some embodiments, an agriculturally compatible carrier or agriculturally acceptable carrier can be used to formulate an agricultural formulation or other composition that includes a purified bacterial preparation. As used herein an "agriculturally compatible carrier" or "agriculturally acceptable carrier" refers to any material, other than water, which can be added to a seed or a seedling without causing or having an adverse effect on the seed (e.g., reducing seed germination) or the plant that grows from the seed, or the like.

As used herein, a "portion" of a plant refers to any part of the plant, and can include distinct tissues and/or organs, and is used interchangeably with the term "tissue" throughout.

A "population" of plants, as used herein, can refer to a plurality of plants that were subjected to the same inoculation or treatment methods described herein, or a plurality of plants that are progeny of a plant or group of plants that were subjected to the inoculation or treatment methods. In addition, a population of plants can be a group of plants that are grown from coated seeds. The plants within a population will typically be of the same species, and will also typically share a common genetic derivation.

A "reference environment" refers to the environment, treatment or condition of the plant in which a measurement is made. For example, production of a compound in a plant associated with a purified bacterial population (e.g., a seed bacterial endophyte) can be measured in a reference environment of drought stress, and compared with the levels of the compound in a reference agricultural plant under the same conditions of drought stress. Alternatively, the levels of a compound in plant associated with a purified bacterial population (e.g., a seed bacterial endophyte) and reference agricultural plant can be measured under identical conditions of no stress.

As used herein, a nucleic acid has "homology" or is "homologous" to a second nucleic acid if the nucleic acid sequence has a similar sequence to the second nucleic acid sequence. The terms "identity," "percent sequence identity" or "identical" in the context of nucleic acid sequences refer to the residues in the two sequences that are the same when aligned for maximum correspondence. There are a number of different algorithms known in the art that can be used to measure nucleotide sequence identity. For instance, polynucleotide sequences can be compared using FASTA, Gap or Bestfit, which are programs in Wisconsin Package Version 10.0, Genetics Computer Group (GCG), Madison, Wis. FASTA provides alignments and percent sequence identity of the regions of the best overlap between the query and search sequences. Pearson, Methods Enzymol. 183:63-98 (1990). The term "substantial homology" or "substantial similarity," when referring to a nucleic acid or fragment thereof, indicates that, when optimally aligned with appropriate nucleotide insertions or deletions with another nucleic acid (or its complementary strand), there is nucleotide sequence identity in at least about 76%, 80%, 85%, or at least about 90%, or at least about 95%, 96%, 97%, 98% 99%, 99.5% or 100% of the nucleotide bases, as measured by any well-known algorithm of sequence identity, such as FASTA, BLAST or Gap, as discussed above.

As used herein, the terms "operational taxon unit," "OTU," "taxon," "hierarchical cluster," and "cluster" are used interchangeably. An operational taxon unit (OTU) refers to a group of one or more organisms that comprises a node in a clustering tree. The level of a cluster is determined by its hierarchical order. In one embodiment, an OTU is a group tentatively assumed to be a valid taxon for purposes of phylogenetic analysis. In another embodiment, an OTU is any of the extant taxonomic units under study. In yet another embodiment, an OTU is given a name and a rank. For example, an OTU can represent a domain, a sub-domain, a kingdom, a sub-kingdom, a phylum, a sub-phylum, a class, a sub-class, an order, a sub-order, a family, a subfamily, a genus, a subgenus, or a species. In some embodiments, OTUs can represent one or more organisms from the kingdoms eubacteria, protista, or fungi at any level of a hierarchal order. In some embodiments, an OTU represents a prokaryotic or fungal order.

As used herein, a "colony-forming unit" ("CFU") is used as a measure of viable microorganisms in a sample. A CFU is an individual viable cell capable of forming on a solid medium a visible colony whose individual cells are derived by cell division from one parental cell.

As used herein, "taxonomically diverse" includes an assemblage of bacteria where individual bacteria are members of distinct taxonomic units at multiple organizational levels (i.e., genera, species and strains).

As used herein, an "entity" or an "endophyte entity" includes a single endophytic organism, such as an endophytic organism having a definite genomic sequence. Generally, two distinct endophyte entities are not clonal with respect to each other and/or have distinct nucleic acid (e.g., genomic) sequences.

As used herein, a "phenotype" of a synthetic combination of a single bacterial endophyte or multiple bacterial endophytes and a plant includes a measurable change in the plant's rate of germination, emergence, growth and/or development including flowering time or additional relevant phenological time points, early and/or total yield, or resistance to abiotic stresses in comparison to plants that have been mock inoculated with a cell-free formulation and grown under identical conditions.

As used herein the terms "spray" or "spraying" include the technique of applying to an exterior surface an ejected liquid material.

As used herein, the terms "coat" or "coating" include application, typically of a liquid or flowable solid, to an exterior surface such as a seed.

As used herein, a "fungicide" includes a commercially available synthetic chemical compound that is designed to protect crop plants from pathogenic fungi and can have detrimental effects on a beneficial fungal and/or bacterial endophyte's growth and ability to successfully colonize a plant host when that plant host has been treated with the fungicide.

As used herein, "encapsulating" includes the process of treating the surface of a plant seed with bacterial and/or fungal endophytes and applying an additional coating that may consist of polymers and/or plasticizers designed to protect the bacterial and/or fungal endophytes from dessication or other abiotic conditions that may reduce the shelf life of the treated seed.

As used herein, a "stabilizer" includes a chemical compound that can be added to a formulation containing living bacterial and/or fungal endophytes to prolong the stability and/or viability of the bacteria or fungi within the formulation, a critical aspect of product shelf-stability. A stabilizer can be one of a variety of compounds, such as a dessicant.

As used herein, a "preservative" includes any chemical compound and/or physical conditions that prevent the decomposition of organic constituents of seeds treated with formulations containing bacterial and/or fungal endophytes. Chemical preservatives could include, for example, synthetic or non-synthetic antioxidants and physical preservatives could include, for example, refrigeration, freeze-drying or drying.

As used herein, a "container" includes a bag or box or other packaging suitable for storing and shipping seeds treated with a formulation that contains beneficial bacterial and/or fungal endophytes. The container may create environmental conditions conducive to the long term stability and viability of the living components of the seed treatment. The container can include a label that consists of information about the treated seed within.

As used herein, a "seed compartment" includes the interior anatomy of a dormant or germinating plant seed, depending on whether or not said seed is a monocot or dicot, the seed compartment could include all plant tissue within the pericarp which can consist of the endosperm, cotelydon, radicle, coleptile, epicotyl and hypocotyl.

As used herein, a "plant cultivar" includes a plant whose selection is due to intentional human activity and has characteristics that can be maintained by propagation. In some embodiments, the plant is a landrace or traditional variety, and in other embodiments is a variety that has been developed by plant breeders and registered with the appropriate government entity.

As used herein, "increased production" includes proteins present at a higher relative abundance in plants that have been treated with individual isolates or combinations of bacterial and/or fungal endophytes compared to plants mock inoculated with a cell-free formulation. Conversely, "reduced production" includes proteins present at a lower relative abundance in plants that have been treated with individual isolates or combinations of bacterial and/or fungal endophytes compared to plants mock inoculated with a cell-free formulation.

As used herein, "immerse" includes the process of briefly placing a seed or seedling into a liquid formulation containing individual bacterial and/or fungal endophytes or combinations of bacterial and/or fungal endophytes for the purpose of inoculating the plant with the endophytes.

As used herein, "injecting" includes the process of using a needle to inoculate the interior of a seed (within the pericarp) with a liquid formulation of bacterial and/or fungal endophytes.

As used herein, "dusting" includes the process of applying a solid, powdered formulation containing bacterial and/or fungal endophytes to a seed.

As used herein, "amplify/amplified," when referring to a nucleic acid, includes using specially designed oligonucleotides in the polymerase chain reaction (PCR) to make multiple copies of a targeted region of genomic or environmental DNA (or cDNA reverse transcribed from genomic or environmental RNA) from a microbe or plant. The targeted region may include taxonomic genes such as 16S rDNA for bacteria and ITS or 18S for fungi as well as functional genes or other regions that may be useful in understanding the taxonomic identity or metabolic capacity of a microbe and/or group of microbes.

As used herein, "collect/collecting" includes selecting and archiving specific plant seeds from existing commercial and public archives and/or experiments and field trials where the plants have been treated with bacterial and/or fungal endophytes for the purpose of isolating additional endophytic microbes and/or assessing the colonization of inoculated plants in a research and development context. A "collection" can also include the isolation from plant tissue, identification and archiving of bacterial and fungal endophytes for the purpose of research and development.

As used herein, "library of bacterial entities" can include an archived collection of bacterial endophytes selected for certain characteristics and used to inoculate plants for research and development. The collection may be an archived collection.

As used herein the phrase "adjacent to vegetation" means within 36 inches (e.g., within 24 inches, within 12 inches, within 6 inches, within 4 increase, within 2 inches, or within 1 inch) of a circle defined around the main plant body.

DETAILED DESCRIPTION

As demonstrated herein, agricultural plants, in particular cereals or *Glycine* plants, can be induced to associate with symbiotic microorganisms termed endophytes, particularly bacteria and fungi, that may have been important during evolution and may contribute to plant survival and performance. However, modern agricultural processes may have perturbed this relationship, resulting in increased crop losses, diminished stress resilience, biodiversity losses, and increasing dependence on external chemicals, fertilizers, and other unsustainable agricultural practices. There is a need for novel methods for generating plants with novel microbiome properties that can sustainably increase yield, stress resilience, and decrease fertilizer and chemical use.

Currently, the generally accepted view of plant endophytic communities focuses on their homologous derivation, predominantly from the soil communities in which the plants are grown (Hallman, J., et al., (1997) Canadian Journal of Microbiology. 43(10): 895-914). Upon observing taxonomic overlap between the endophytic and soil microbiota in *A. thaliana*, it was stated, "Our rigorous definition of an endophytic compartment microbiome should facilitate controlled dissection of plant-microbe interactions derived from complex soil communities" (Lundberg et al., (2012) Nature. 488, 86-90). There is strong support in the art for soil representing the repository from which plant endophytes are derived (New Phytologist (2010) 185: 554-567). Notable plant-microbe interactions such as mycorrhyzal fungi and bacterial *rhizobia* fit the paradigm of soil-based colonization of plant hosts and appear to primarily establish themselves independently of seed. As a result of focusing attention on the derivation of endophytes from the soil in which the target agricultural plant is currently growing, there has been an inability to achieve commercially significant improvements in plant yields and other plant characteristics such as increased root biomass, increased root length, increased height, increased shoot length, increased leaf number, increased water use efficiency, increased overall biomass, increase yield (or grain yield), increased photosynthesis rate, increased tolerance to drought, increased heat tolerance, increased salt tolerance, increased resistance to nematode stress, increased resistance to a fungal pathogen, increased resistance to a bacterial pathogen, increased resistance to a viral pathogen, a detectable modulation in the level of a metabolite, and a detectable modulation in the proteome relative to a reference plant.

In part, the present invention describes preparations of novel seed-derived endophytes, and the creation of synthetic combinations of agricultural plant seeds and/or seedlings with seed-derived endophytes (e.g., heterologous seed endophytes) and formulations containing the synthetic combinations, as well as the recognition that such synthetic combinations display a diversity of beneficial properties present in the agricultural plants and the associated endophyte populations newly created by the present inventors. Such beneficial properties include metabolism, transcription, proteome alterations, morphology, and the resilience to a variety of environmental stresses, and the combination of a plurality of such properties.

Little attention has been provided in the art to understanding the role of seeds as reservoirs for microbes that can efficiently populate the endosphere of cereal or soy plants. While the concept that seeds may harbor plant pathogens was promoted by Baker and Smith (Annu Rev Phytopathol 14: 311-334(1966)), and the understanding that bacterial and fungal pathogens are known to be able to infect seed, the ability to harness endophytes derived from a broad spectrum of seeds to heterologously confer single or multiple advantages to cereal and soy crops was previously unrecognized. As the presence of detectable pathogens in a seed lot can necessitate destruction of vast numbers of agricultural germplasm (Gitaitis, R. and Walcott, R. (2007) Annu Rev. Phytopathol. 45:371-97), safety concerns have surrounded the consideration of seed-associated microbes or non-soil endophytes. Moreover, when seed pathogens are detected, their transfer to the growing plant can be highly inefficient. For example, a study of seed-based transmission of the seed pathogen, *Pantoea stewartii*, found that seed produced from a population of pathogen-infected plants gave rise to infected seedlings in only 0.0029% of cases (1 of 34,924 plants) and artificially infected kernels only gave rise to infected seedlings in 0.022% of cases (Block, C. C., el al., (1998). Plant disease. 82(7). 775-780). Thus, the efficiency with which plants introduce microbes into their seeds, and with which microbes within seeds propagate within the resulting plant tissues, has been previously thought to be low and often substantially variable. Thus, the potential for microbial content within cereal and other agricultural seeds such as soy to populate the resulting plant has been unclear.

The potential for agricultural cereal and soy seeds to serve as reservoirs for non-pathogenic microbes also remains controversial (Hallman, J., et al., (1997) Canadian Journal of Microbiology. 43(10): 895-914). Sato, et al., did not detect any bacteria inside rice seeds ((2003) In. Morishima, H. (ed.) The Natural History of Wild Rice—Evolution Ecology of Crop. p. 91-106) and Mundt and Hinkle only obtained endophytes from seed samples where seed coats had been broken or fractured in 29 kinds of plant seed (Appl Environ Microbiol. (1976) 32(5):694-8). Another group detected simply bacterial populations inside rice seeds ranging in population size from $10^2$ to $10^6$ CFU/g fresh weight (Okunishi, S., et al., (2005) Microbes and Environment. 20:168-177). Rosenblueth et al described seeds to harbor very simple microbial communities with significant variability of the microbial communities between individual maize seeds, including substantial variability between seeds taken from the same cobb (Rosenblueth, M. et al, Seed Bacterial Endophytes: Common Genera, Seed-to-Seed Variability and Their Possible Role in Plants; Proc. XXVIIIth IHC-IS on Envtl., Edaphic & Gen. Factors; Affecting Plants, Seeds and Turfgrass; Eds.: G. E. Welbaum et al. Acta Hort. 938, ISHS 2012).

These findings demonstrate limitations recognized in the art regarding the attempted use of endophytes derived from seeds; i.e., maize seeds appear to contain limited taxonomic diversity, and that the microbiota of individual seeds produced by plants is often distinct, indicating that there may not be single seed-derived symbionts capable of providing benefits or traits across a large population of agricultural plants and in specific, the utilization of endophytes on seed. For example, characterization of ~15 pooled seeds from within various cultivars from the genus *Zea* showed that populations of maize seeds tend to harbor a very limited number of taxa that appear to be conserved across modern and ancestral variants, and that the maize seed content of such taxa is low and substantially variable. It is unclear whether the presence of such limited taxa resulted from common storage conditions, environmental contamination, or a potential vertical transmission of microbes via seeds, and also uncertain was the applicability of such limited taxa in increasing agricultural yield. Notably, 99% of these strains were shown to provide detrimental or to lack beneficial effects on agricultural plants, e.g., when tested in a non-seed-based, pre-root-bearing potato growth assay (i.e., based on nodal potato explants lacking roots) (Johnston-Monje D, Raizada M N (2011) Conservation and Diversity of Seed Associated Endophytes in *Zea* across Boundaries of Evolution, Ethnography and Ecology. PLoS ONE 6(6): e20396. doi:10.1371/journal.pone.0020396). Further, some of the microbes isolated bear close evolutionary relation to plant pathogens, making it possible that such microbes represent a latent reservoir of pathogens, rather than potentially beneficial constituents.

Surprisingly, it was discovered here that seed-derived endophytes can confer significant advantages to cereal or soybean crops, spanning growth under normal and stressed conditions, altered expression of key plant hormones, altered expression of key proteins in the plant, and other desirable features. Provided are novel compositions, methods, and products related our invention's ability to overcome the limitations of the prior art in order to provide reliable increases in yield, biomass, germination, vigor, stress resilience, and other properties to agricultural crops.

The invention described herein is surprising for multiple reasons based on the previous demonstrations in the art. Notably, there is a lack of clarity related to whether endophytes are associated with healthy cereal or soy seeds, whether microbes isolated from cereal or soy seeds could efficiently colonize the cereal or soy host if disposed on the exterior of a seed or seedling, and whether such microbes would confer a beneficial or detrimental effects on cereal or soy hosts. It is further unclear whether the heterologous application of such microbes to distinct cereal seeds from which they were derived could provide beneficial effects.

As described herein, beneficial microbes can be robustly derived from agricultural seeds, optionally cultured, administered, e.g., heterologously, to agricultural cereal or *Glycine* seeds or seedlings, and colonize the resulting plant tissues with high efficiency to confer multiple beneficial properties or traits. This is surprising given the variability observed in the art in microbe isolation from healthy seeds and the previous observations of inefficient seed pathogen colonization of plant host's tissues. Further, the ability of heterologously disposed seed-derived endophytes to colonize seeds and seedlings from the exterior of seeds is surprising, given that such endophytes can be isolated from within internal seed tissues and therefore do not natively need the capacity to externally penetrate and invade into host tissues.

Prior characterization of microbial content of seeds has indicated that microbial concentrations in seeds can be variable and are generally very low (i.e., less than 10, 100, $10^3$, $10^4$, $10^5$ CFUs/seed). As such, it was unclear whether altered or increased concentrations of microbes associated with seeds could be beneficial. We find that microbes (e.g., seed bacterial endophytes) can confer beneficial properties across a range of concentrations.

We find that seed-derived endophytes can be heterologously disposed onto seedlings of a distinct cultivar, species, or crop type (e.g., cereal or soybean) and confer benefits to those new recipients. For example, seed-derived endophytes from corn cultivars can be heterologously provided to wheat cultivars to confer a benefit. For example, seed-derived endophytes from corn cultivars can be heterologously provided to soybean cultivars to confer a benefit. This is surprising given the observations of distinct microbiome preferences in distinct plant and mammalian hosts and, in particular, the likelihood that microbes derived from seeds have been co-evolved to be specialized to a particular host.

We further find that combinations of heterologously disposed seed-derived endophytes confer additive advantages to plants, including multiple functional properties and resulting in seed, seedling, and plant hosts that display single or multiple improved agronomic properties.

In general, this application provides methods and materials for providing a benefit to a seed or seedling of an agricultural plant using purified bacterial populations that include novel seed endophytes (e.g., seed bacterial endophytes) that are unique in that they have been isolated from seeds of grass or soybean plants. Such seed bacterial endophytes can provide beneficial properties or traits to the seed, seedling, or the agricultural plant derived from the seed or seedling, including benefits to metabolism, transcription, proteome alterations, morphology, and the resilience to a variety of environmental stresses, and combinations of such properties.

As described herein, synthetic combinations that include a host plant such as a *Glycine* plant (e.g., a *Glycine max* plant) or an agricultural grass plant associated with a purified bacterial population that contains an endophyte, e.g., a seed bacterial endophyte, can be used to provide the benefit to a seed, seedling, or agricultural plant derived from the seed or seedling. The synthetic combination may be produced, for example, by inoculation, application to foliage (e.g., by spraying) or to seeds (e.g., coating of seeds), grafting, root dips, soil drenches, or infection of a host plant, host plant tissues, or a seed, or combinations thereof, as described herein. In any of the methods, any of such techniques can be used to make synthetic combinations. Inoculation, application to foliage or seeds, or infection can be particularly useful.

In some embodiments, the invention uses microbes (e.g., seed bacterial endophytes) that are heterologous to a seed or plant in making synthetic combinations or agricultural formulations. A microbe is considered heterologous to the seed or plant if the seed or seedling that is unmodified (e.g., a seed or seedling that is not treated with an endophyte population described herein) does not contain detectable levels of the microbe. For example, the invention contemplates the synthetic combinations of seeds or seedlings of agricultural plants (e.g., *Glycine* plants or agricultural grass plants) and an endophytic microbe population (e.g., a seed bacterial endophyte), in which the microbe population is "heterologously disposed" on the exterior surface of or within a tissue of the agricultural seed or seedling in an amount effective to colonize the plant. A microbe is considered "heterologously disposed" on the surface or within a plant (or tissue) when the microbe is applied or disposed on the plant in a number that is not found on that plant before application of the microbe. For example, a bacterial endophytic population that is disposed on an exterior surface or within the seed can be an endophytic bacterium that may be associated with the mature plant, but is not found on the surface of or within the seed. As such, a microbe is deemed heterologously disposed when applied on the plant that either does not naturally have the microbe on its surface or within the particular tissue to which the microbe is disposed, or does not naturally have the microbe on its surface or within the particular tissue in the number that is being applied. Indeed, several of the endophytic microbes described herein have not been detected, for example, in any of the corn seeds sampled, as determined by highly sensitive methods.

In some embodiments, a microbe can be "endogenous" to a seed or plant. As used herein, a microbe is considered "endogenous" to a plant or seed, if the microbe is derived from, or is otherwise found in, the seed or the plant, or any plant or seed of the same species. In embodiments in which an endogenous microbe is applied, the endogenous microbe is applied in an amount that differs (e.g., an increased level or amount) from the amounts typically found in the plant.

Seed Bacterial Endophytes

In some embodiments, this application relates to purified bacterial populations that contain seed bacterial endophytes from, for example, maize, wheat, rice, barley, or soybean, compositions such as agricultural formulations, seed treatments, synthetic combinations, agricultural products, treated seeds (e.g., coated seeds), or articles of manufacture that include such purified bacterial populations, as well as methods of using such bacterial populations to make synthetic combinations or agricultural products such as agricultural seed preparations. A seed bacterial endophyte used in a composition or used to make a synthetic composition (or any other composition, article, formulation, or preparation described herein) can be obtained from the same cultivar or species of agricultural plant to which the composition is being applied or can be obtained from a different cultivar or species of agricultural plant.

Many bacterial species are sensitive to conditions of drying and desiccation. Surprisingly, the bacterial endophytes described herein have been isolated from mature, dry seeds of grass plants, including maize, rice, and wheat seeds. The recovery of viable bacterial endophytes from these mature dry seeds demonstrates that, unlike most other bacteria, these seed bacterial endophytes are capable of surviving conditions of desiccation. Therefore, in one embodiment, the purified bacterial population containing seed bacterial endophytes is desiccation tolerant. For example, a substantial portion of the population (e.g., at least 5, 10, 15, 20, 25, 30, 35, 40, 45, 50, 55, 60, 65, 70, 75, 80, 85, 90, 95, 96, 97, 98, 99, or greater than 99%) of the seed bacterial endophytes can survive in moisture content levels of 30% or less, for example, 25% or less, 20% or less, 15% or less, 12% or less, 10% or less, or 8% or less, for a period of at least 1 day, for example, at least 3 days, at least 5 days, at least 7 days, at least 10 days, at least 14 days, at least 21 days, at least 30 days, at least 45 days, at least 60 days, or more, within the seeds of a grass plant that are stored at between 1° C. and 35° C.

In another embodiment, the seed bacterial endophyte is capable of forming spores. In still another embodiment, at least 1% of the population of the seed bacterial endophyte, for example, at least 5%, at least 10%, at least 20%, at least 30%, at least 40%, at least 50%, at least 75%, at least 80%, at least 90%, or at least 95% or more, is used in spore form.

In some embodiments, the seed bacterial endophyte can be cultured on a culture medium or can be adapted to culture on a culture medium.

In some embodiments, a purified bacterial population is used that includes two or more (e.g., 3, 4, 5, 6, 7, 8, 9, 10, 15, 20, 25 or greater than 25) different seed bacterial endophytes, e.g., obtained from different families or different genera of bacteria, or from the same genera but different species of bacteria. The different seed bacterial endophytes can be obtained from the same cultivar of agricultural plant (e.g., the same maize, wheat, rice, barley, or soybean plant), different cultivars of the same agricultural plant (e.g., two or more cultivars of maize, two or more cultivars of wheat, two or more cultivars of rice, two or more cultivars of barley, or two or more cultivars of soybean), or different species of the same type of agricultural plant (e.g., two or more different species of maize, two or more different species of wheat, two or more different species of rice, two or more different species of barley, or two or more different species of soybean). In embodiments in which two or more seed bacterial endophytes are used, each of the seed bacterial endophytes can have different properties or activities, e.g., produce different metabolites, produce different enzymes such as different hydrolytic enzymes, confer different beneficial traits, or colonize different parts of a plant (e.g., leaves, stems, flowers, fruits, seeds, or roots). For example, one seed bacterial endophyte can colonize a first and a second seed bacterial endophyte can colonize a tissue that differs from the first tissue. Combinations of bacterial endophytes are discussed in detail below.

In one embodiment, the endophyte is an endophytic microbe isolated from a different plant than the inoculated plant. For example, in one embodiment, the endophyte is an endophyte isolated from a different plant of the same species as the inoculated plant. In some cases, the endophyte is isolated from a species related to the inoculated plant.

The breeding of plants for agriculture, as well as cultural practices used to combat microbial pathogens, may have resulted in the loss in modern cultivars of the endophytes present in their wild ancestors, or such practices may have inadvertently promoted other novel or rare plant-endophyte interactions, or otherwise altered the microbial population. We hypothesized that an altered diversity and titer of endophytes in the ancestor could correlate with an altered range of physiological responses derived from the symbiosis that allow the plant to better adapt to the environment and tolerate stress. In order to survey plant groups for potentially useful endophytes, seeds of their wild ancestors, wild relatives, primitive landraces, modern landraces, modern breeding lines, and elite modern agronomic varieties are screened for microbial endophytes by culture and culture independent methods as described herein.

In some cases, plants are inoculated with endophytes that are heterologous to the seed of the inoculated plant. In one embodiment, the endophyte is derived from a plant of another species. For example, an endophyte that is normally found in dicots is applied to a monocot plant (e.g., inoculating corn with a soy bean-derived endophyte), or vice versa. In other cases, the endophyte to be inoculated onto a plant is derived from a related species of the plant that is being inoculated. In one embodiment, the endophyte is derived from a related taxon, for example, from a related species. The plant of another species can be an agricultural plant. For example, an endophyte derived from *Hordeum irregulare* can be used to inoculate a *Hordeum vulgare* L., plant. Alternatively, it is derived from a 'wild' plant (i.e., a non-agricultural plant). For example, endophytes normally associated with the wild cotton *Gossypium klotzschianum* are useful to inoculate commercial varieties of *Gossypium hirsutum* plants. As an alternative example of deriving an endophyte from a 'wild' plant, endophytic bacteria isolated from the South East Asian jungle orchid, *Cymbidium eburneum*, can be isolated and testing for their capacity to benefit seedling development and survival of agricultural crops such as wheat, maize, soy and others (Facia, D. C., et al., (2013) *World Journal of Microbiology and Biotechnol-* ogy. 29(2). pp. 217-221). In other cases, the endophyte can be isolated from an ancestral species of the inoculated plant. For example, an endophyte derived from Zea diploperennis can be used to inoculate a commercial variety of modern corn, or Zea mays.

In some embodiments, a purified bacterial populations contains seed bacterial endophytes from one or more (e.g., two, three, four, five, six, seven, eight, nine, 10, or more families selected from the group consisting of Acidithiobacillaceae, Actinosynnemataceae, Aerococcaceae, Aeromonadaceae, Alcaligenaceae, Alteromonadaceae, Bacillaceae, Bdellovibrionaceae, Bradyrhizobiaceae, Brucellaceae, Burkholderiaceae, Carnobacteriaceae, Caulobacteraceae, Cellulomonadaceae, Chitinophagaceae, Chromatiaceae, Clostridiaceae, Comamonadaceae, Coriobacteriaceae, Corynebacteriaceae, Deinococcaceae, Ectothiorhodospiraceae, Enterobacteriaceae, Flavobacteriaceae, Halomonadaceae, Hyphomicrobiaceae, Lachnospiraceae, Lactobacillaceae, Methylobacteriaceae, Microbacteriaceae, Micrococcaceae, Moraxellaceae, Mycobacteriaceae, Neisseriaceae, Nocardiaceae, Oxalobacteraceae, Paenibacillaceae, Planococcaceae, Propionibacteriaceae, Pseudonocardiaceae, Rhizobiaceae, Rhodospirillaceae, Sphingobacteriaceae, Sphingomonadaceae, Streptomycetaceae, Tissierellaceae, Weeksellaceae, Xanthobacteraceae, and Xanthomonadaceae.

In one embodiment, the purified bacterial population includes seed bacterial endophytes is from one or more families selected from the group consisting of Xanthomonadaceae, Sphingomonadaceae, Weeksellaceae, Microbacteriaceae, Micrococcaceae, Methylobacteriaceae, Xanthomonadaceae, Rhizobiaceae, Paenibacillaceae, Staphylococcaceae, Enterobacteriaceae, Pseudomonadaceae, and Bacillaceae.

In some embodiments, the purified bacterial population includes seed bacterial endophytes from one or more (e.g., two, three, four, five, six, seven, eight, nine, 10, or more) of the generas selected from the group consisting of *Achromobacter, Acidithiobacillus, Acidovorax, Acidovoraz, Acinetobacter, Aerococcus, Aeromonas, Agromyces, Ancylobacter, Arthrobacter, Azospirillum, Bacillus, Bdellovibrio, Bosea, Bradyrhizobium, Brevibacillus, Brevundimonas, Burkholderia, Cellulomonas, Cellvibrio, Chryseobacterium, Citrobacter, Clostridium, Corynebacterium, Cupriavidus, Curtobacterium, Curvibacter, Deinococcus, Desemzia, Devosia, Dokdonella, Dyella, Enhydrobacter, Enterobacter, Enterococcus, Erwinia, Escherichia, Finegoldia, Flavisolibacter, Flavobacterium, Frigoribacterium, Hafnia, Halomonas, Herbaspirillum, Klebsiella, Kocuria, Lactobacillus, Leclercia, Lentzea, Luteibacter, Luteimonas, Massilia, Methylobacterium, Microbacterium, Micrococcus, Microvirga, Mycobacterium, Neisseria, Nocardia, Oceanibaculum, Ochrobactrum, Oxalophagus, Paenibacillus, Panteoa, Pantoea, Plantibacter, Propionibacterium, Propioniciclava, Pseudomonas, Pseudonocardia, Pseudoxanthomonas, Psychrobacter, Rheinheimera, Rhizobium, Rhodococcus, Roseateles, Ruminococcus, Sediminibacillus, Sediminibacterium, Serratia, Shigella, Shinella, Sphingobacterium, Sphingomonas, Sphingopyxis, Sphingosinicella, Staphylococcus, Stenotrophomonas, Strenotrophomonas, Streptomyces, Tatumella, Tepidimonas, Thermomonas, Thiobacillus, Uncultured bacterium, Variovorax*, and *Xanthomonas*.

In some embodiments, the purified bacterial population does not include at least one of *Acetobacter* sp., *Acidovorax facilis, Azospirillum brasilense, Azospirillum lipoferum, Azospirillum* sp., *Azotobacter* sp., *Azotobacter vinelandii, Bacillus amyloliquefaciens* FZB42, *Bacillus amyloliquefaciens* strain D747, *Bacillus amyloliquefaciens* TJ1000, *Bacillus amyloliquefaciens* TM45, *Bacillus chitinosporus, Bacillus firmus, Bacillus firmus* NCIM 2637, *Bacillus firmus* I-1582, *Bacillus laterosporus, Bacillus licheniformis, Bacillus licheniformis, Bacillus marinus, Bacillus megaterium, Bacillus megaterium* var. *phosphaticum, Bacillus megatherium, Bacillus oleronius, Bacillus pumilus, Bacillus pumilus* QST 2808, *Bacillus* sp., *Bacillus subtilis, Bacillus subtilis* FZB24, *Bacillus subtilis* MBI 600, *Bacillus subtilis* BSF4, *Bacillus subtilis* MBI600, *Bacillus subtilis* QST 713, *Bacillus thuringensis* var *Kurstaki* (NCIM 2514), *Bacillus thuringiensis aizawai, Bacillus thuringiensis kurstaki, Bacillus thuringiensis kurstaki* strain EG7841, *Bacillus thuringiensis kurstaki* strain SA-11, *Bacillus thuringiensis* subsp. *kurstaki* ABTS-351, *Bacillus thuringiensis* SV *kurstaki* EG 2348, *Bacillus thuringiensis* var *Israelensis, Bacillus thuringiensis, Kurstaki variety*, serotype 3A 3B, *Bacillus thuringiensis*, subsp. *aizawai*, Strain ABTS-1857, *Bacillus thuringiensis*, subsp. *israelensis*, strain AM 65-52, *Chromobacterium subtsugae* strain PRAA4-1, *Delftia acidovorans, Frateuria aurantia, Lactobacillus casei, Lactobacillus delbrueckii, Lactobacillus fermentum, Lactobacillus helveticus, Lactobacillus plantarum, Lactococcus lactus, Methylobacterium mesophilicum, Methylobacterium organophilum, Methylobacterium extorquens, Paenibacillus polymyxa, Pasteuria* spp., *Pseudomonas* spp., *Pseudomonas fluorescens, Rhizobium* sp., *Rhodococcus rhodochrous, Rhodopseudomonas palustris, Streptomyces lydicus* WYEC 108, *Streptomyces ray*, or *Thiobacillus thiooxidans*, and combinations of such organisms.

In some embodiments, the purified fungal population does not include at least one of *Acremonium butyri, Ampelomyces quisqualis, Ampelomyces quisqualis* (DSM 2222), *Ampelomyces quisqualis* M-10, *Arthrobotrys oligospora, Aspergillus oryzae, Beauvaria bassiana* strain ATCC 74040, *Beauveria bassiana, Beauveria bassiana* (NCIM 1216 ATCC 26851), *Beauveria bassiana* strain GHA, *Beauveria bassiana* strain GHA 1991, *Candida utilis, Chaetomium cupreum* (CABI 353812), *Chaetomium globosum, Clonostachys rosea* 88-710, *Fusarium oxysporum* IF23, *Fusarium proliferatum* (NCIM 1101), *Gliocladium, Gliocladium catenulatum* strain J1446, *Gliocladium virens* GL-21, *Glomus fasciculatum, Glomus intraradices, Hirsutella rhossiliensis, Isaria fumosorosea Apopka* Strain 97, *Metarhizium anisopliae, Metarhizium anisopliae* (NCIM 1311), *Metschnikowia fructicola, Myrothecium verrucaria, Neotyphodium lolii* AR1, *Neotyphodium lolii* AR37, *Neotyphodium lolii* AR6, *Neotyphodium lolii* NEA2, *Neotyphodium uncinatum, Paecilomyces fumorosoroseus* strain FE 9901, *Paecilomyces fumosoroseus, Paecilomyces lilacinus, Paecilomyces lilacinus* (IIHR PL-2), *Penicillium bilaii, Saccharomyces cerevisiae, Sclerotinia minor, Trichoderma asperellum* TV1, *Trichoderma asperellum* strain ICC 012, *Trichoderma gamsii* strain ICC 080, *Trichoderma harzianum, Trichoderma harzianum* (IIHR-Th-2), *Trichoderma harzianum Rifai* strain T22, *Trichoderma koningii, Trichoderma lignorum, Trichoderma polysporum, Trichoderma* sp., *Trichoderma virens* Gl-3, *Trichoderma viride, Trichoderma viride* (TNAU), *Verticillium lecanii*, or *Verticillium lecanii* (NCIM 1312) and combinations of such organisms.

In some embodiments, the purified bacterial population includes seed bacterial endophytes from a non-*Bacillus* and/or a non-*Pseudomonas* genera and/or a non-*Rhizobium* genera, e.g., from one or more of *Achromobacter, Acidithiobacillus, Acidovorax, Acidovoraz, Acinetobacter, Aerococcus, Aeromonas, Agromyces, Ancylobacter, Arthrobacter,*

*Azospirillum, Bdellovibrio, Bosea, Bradyrhizobium, Brevibacillus, Brevundimonas, Burkholderia, Cellulomonas, Cellvibrio, Chryseobacterium, Citrobacter, Clostridium, Corynebacterium, Cupriavidus, Curtobacterium, Curvibacter, Deinococcus, Desemzia, Devosia, Dokdonella, Dyella, Enhydrobacter, Enterobacter, Enterococcus, Erwinia, Escherichia, Finegoldia, Flavisolibacter, Flavobacterium, Frigoribacterium, Hafnia, Halomonas, Herbaspirillum, Klebsiella, Kocuria, Lactobacillus, Leclercia, Lentzea, Luteibacter, Luteimonas, Massilia, Methylobacterium, Microbacterium, Micrococcus, Microvirga, Mycobacterium, Neisseria, Nocardia, Oceanibaculum, Ochrobactrum, Oxalophagus, Paenibacillus, Panteoa, Pantoea, Plantibacter, Propionibacterium, Propioniciclava, Pseudonocardia, Pseudoxanthomonas, Psychrobacter, Rheinheimera, Rhodococcus, Roseateles, Ruminococcus, Sediminibacillus, Sediminibacterium, Serratia, Shigella, Shinella, Sphingobacterium, Sphingomonas, Sphingopyxis, Sphingosinicella, Staphylococcus, Stenotrophomonas, Strenotrophomonas, Streptomyces, Tatumella, Tepidimonas, Thermomonas, Thiobacillus, Uncultured bacterium, Variovorax,* or *Xanthomonas.*

In some embodiments, the purified bacterial population includes seed bacterial endophytes from a genera selected from the group consisting of *Luteibacter, Sphingobium, Chryseobacterium, Curtobacterium, Micrococcus, Sphingomonas, Microbacterium, Methylobacterium, Stenotrophomonas, Xanthomonas, Agrobacterium, Paenibacillus, Staphylococcus, Enterobacter, Pantoea, Pseudomonas,* and *Bacillus.* In some embodiments, the purified bacterial populations includes seed bacterial endophytes from a non-*Bacillus*, and/or a non-*Pseudomonas* genera and/or a non-*Rhizobium* genera, e.g., from one or more of *Luteibacter, Sphingobium, Chryseobacterium, Curtobacterium, Micrococcus, Sphingomonas, Microbacterium, Methylobacterium, Stenotrophomonas, Xanthomonas, Agrobacterium, Paenibacillus, Staphylococcus, Enterobacter,* or *Pantoea.*

In some embodiments, the seed bacterial endophyte includes a 16S nucleic acid sequence that is at least 97% identical to at least one of the nucleic acid sequences referenced in Table 1 or Table 2 (SEQ ID NOs: 1-1448, e.g., SEQ ID NOs: 521-1448). For example, the seed bacterial endophyte can include a 16S nucleic acid sequence that is at least 98% identical, at least 99% identical, or at least 99.5% identical to a 16S nucleic acid sequence referenced in Table 1 or Table 2 (SEQ ID NOs: 1-1448, e.g., SEQ ID NOs: 521-1448). In some embodiments, the seed bacterial endophyte comprises a 16S nucleic acid sequence that is 100% identical to a 16S nucleic acid sequence referenced in Table 1 or Table 2 (SEQ ID NOs: 1-1448, e.g., SEQ ID NOs: 521-1448). In embodiments in which two or more seed bacterial endophytes are used, the 16S nucleic acid sequence of each seed bacterial endophyte can have more than 97% sequence identity to each other or can have less than 97% sequence identity (e.g., 90-96%, 90-97%, 90%, 91%, 92%, 93%, 94%, 95%, or 96%) to each other. In addition, in embodiments in which two or more seed bacterial endophytes are used, the 16S nucleic acid sequence of one seed bacterial endophyte can have more than 97% sequence identity to one of the nucleotide sequences set forth in SEQ ID NOs: 1-1448, and one seed bacterial endophyte can have less than 97% (e.g., 90-96%, 90-97%, 90%, 91%, 92%, 93%, 94%, 95%, or 96%) sequence identity to one of the 16S nucleotide sequences set forth in SEQ ID NOs:1-1448.

In some embodiments, the seed bacterial endophyte includes a 16S nucleic acid sequence that has less than 97% (e.g., 90-96%, 90-97%, 90%, 91%, 92%, 93%, 94%, 95%, or 96%) sequence identity to at least one of the nucleic acid sequences referenced in Table 1 or Table 2 (SEQ ID NOs: 1-1448).

TABLE 1

Representative endophytes from grass seeds, including their 16S rRNA sequences, assignment within OTU numbers, Genus, species, strain information, as well as GenBank Accession numbers.

| SEQ ID NO. | OTU # | Genus | Species | Strain | Accession No. |
|---|---|---|---|---|---|
| 1 | 37 | Burkholderia | fungorum | | JF753273 |
| 2 | 37 | Burkholderia | fungorum | | JF753274 |
| 3 | 27 | Burkholderia | gladioli | | JF753275 |
| 4 | 21 | Citrobacter | freundii | | JF753276 |
| 5 | 21 | Citrobacter | freundii | | JF753277 |
| 6 | 61 | Clostridium | acetobutylicum | | JF753278 |
| 7 | 61 | Clostridium | beijerinckii | | JF753279 |
| 8 | 0 | Enterobacter | absuriae | | JF753280 |
| 9 | 0 | Enterobacter | absuriae | | JF753281 |
| 10 | 0 | Enterobacter | aerogenes | | JF753282 |
| 11 | 0 | Enterobacter | aerogenes | | JF753283 |
| 12 | 18 | Enterobacter | asburiae | | JF753284 |
| 13 | 156 | Enterobacter | asburiae | | JF753285 |
| 14 | 0 | Enterobacter | asburiae | | JF753286 |
| 15 | 0 | Enterobacter | asburiae | | JF753287 |
| 16 | 0 | Enterobacter | asburiae | | JF753288 |
| 17 | 0 | Enterobacter | asburiae | | JF753289 |
| 18 | 0 | Enterobacter | asburiae | J2S4 | JF753290 |
| 19 | 18 | Enterobacter | asburiae | MY2 | JF753291 |
| 20 | 18 | Enterobacter | asburiae | MY2 | JF753292 |
| 21 | 21 | Enterobacter | asburiae | J2S4 | JF753293 |
| 22 | 18 | Enterobacter | cloacae | | JF753294 |
| 23 | 18 | Enterobacter | cloacae | | JF753295 |
| 24 | 177 | Enterobacter | ludwigii | AR1.22 | JF753296 |
| 25 | 56 | Enterobacter | sp. | Nj-68 | JF753297 |
| 26 | 18 | Escherichia | coli | | JF753298 |
| 27 | 18 | Escherichia | coli | | JF753299 |
| 28 | 18 | Escherichia | coli | | JF753300 |
| 29 | 18 | Escherichia | coli | NBRI1707 | JF753301 |
| 30 | 18 | Escherichia | coli | NBRI1707 | JF753302 |

TABLE 1-continued

Representative endophytes from grass seeds, including their 16S rRNA sequences, assignment within OTU numbers, Genus, species, strain information, as well as GenBank Accession numbers.

| SEQ ID NO. | OTU # | Genus | Species | Strain | Accession No. |
|---|---|---|---|---|---|
| 31 | 18 | *Escherichia* | *coli* | NBRI1707 | JF753303 |
| 32 | 18 | *Klebsiella* | *pneumoniae* | 342 | JF753304 |
| 33 | 82 | *Luteibacter* | sp. | | JF753305 |
| 34 | 81 | *Methylobacterium* | sp. | | JF753306 |
| 35 | 31 | *Paenibacillus* | *caespitis* | | JF753307 |
| 36 | 49 | *Paenibacillus* | *ruminocola* | G22 | JF753308 |
| 37 | 18 | *Panteoa* | *agglomerans* | | JF753309 |
| 38 | 109 | *Pantoea* | *agglomerans* | | JF753310 |
| 39 | 146 | *Pantoea* | *agglomerans* | | JF753311 |
| 40 | 109 | *Pantoea* | *agglomerans* | 1.2244 | JF753312 |
| 41 | 84 | *Pantoea* | *agglomerans* | 1.2244 | JF753313 |
| 42 | 0 | *Pantoea* | *agglomerans* | 1.2244 | JF753314 |
| 43 | 0 | *Pantoea* | *agglomerans* | 1.2244 | JF753315 |
| 44 | 84 | *Pantoea* | *agglomerans* | 1.2244 | JF753316 |
| 45 | 7 | *Pantoea* | *agglomerans* | BJCP2 | JF753317 |
| 46 | 58 | *Pantoea* | *agglomerans* | BJCP2 | JF753318 |
| 47 | 146 | *Pantoea* | *agglomerans* | KJPB2 | JF753319 |
| 48 | 164 | *Pantoea* | *agglomerans* | KJPB2 | JF753320 |
| 49 | 0 | *Pantoea* | *agglomerans* | Sc-1 | JF753321 |
| 50 | 0 | *Pantoea* | *agglomerans* | Sc-1 | JF753322 |
| 51 | 0 | *Pantoea* | *agglomerans* | Sc-1 | JF753323 |
| 52 | 0 | *Pantoea* | *agglomerans* | Sc-1 | JF753324 |
| 53 | 0 | *Pantoea* | *agglomerans* | Sc-1 | JF753325 |
| 54 | 0 | *Pantoea* | *agglomerans* | Sc-1 | JF753326 |
| 55 | 0 | *Pantoea* | *agglomerans* | Sc-1 | JF753327 |
| 56 | 0 | *Pantoea* | *agglomerans* | Sc-1 | JF753328 |
| 57 | 0 | *Pantoea* | *agglomerans* | Sc-1 | JF753329 |
| 58 | 0 | *Pantoea* | *agglomerans* | Sc-1 | JF753330 |
| 59 | 0 | *Pantoea* | *agglomerans* | Sc-1 | JF753331 |
| 60 | 0 | *Pantoea* | *agglomerans* | Sc-1 | JF753332 |
| 61 | 0 | *Pantoea* | *agglomerans* | Sc-1 | JF753333 |
| 62 | 164 | *Pantoea* | *agglomerans* | TX4CB_114 | JF753334 |
| 63 | 0 | *Pantoea* | *agglomerans* | TX4CB_114 | JF753335 |
| 64 | 164 | *Pantoea* | *agglomerans* | 1.2244 | JF753336 |
| 65 | 84 | *Pantoea* | *agglomerans* | 1.2244 | JF753337 |
| 66 | 84 | *Pantoea* | *agglomerans* | 1.2244 | JF753338 |
| 67 | 84 | *Pantoea* | *agglomerans* | 1.2244 | JF753339 |
| 68 | 84 | *Pantoea* | *agglomerans* | 1.2244 | JF753340 |
| 69 | 0 | *Pantoea* | *agglomerans* | 48b/90 | JF753341 |
| 70 | 127 | *Pantoea* | *agglomerans* | 48b/90 | JF753342 |
| 71 | 0 | *Pantoea* | *agglomerans* | 48b/90 | JF753343 |
| 72 | 7 | *Pantoea* | *agglomerans* | BJCP2 | JF753344 |
| 73 | 7 | *Pantoea* | *agglomerans* | BJCP2 | JF753345 |
| 74 | 0 | *Pantoea* | *agglomerans* | AN3 | JF753346 |
| 75 | 84 | *Pantoea* | *agglomerans* | KJPB2 | JF753347 |
| 76 | 164 | *Pantoea* | *agglomerans* | KJPB2 | JF753348 |
| 77 | 84 | *Pantoea* | *agglomerans* | KJPB2 | JF753349 |
| 78 | 164 | *Pantoea* | *agglomerans* | KJPB2 | JF753350 |
| 79 | 0 | *Pantoea* | *agglomerans* | KJPB2 | JF753351 |
| 80 | 0 | *Pantoea* | *agglomerans* | new*47con | JF753352 |
| 81 | 0 | *Pantoea* | *agglomerans* | Sc-1 | JF753353 |
| 82 | 0 | *Pantoea* | *agglomerans* | Sc-1 | JF753354 |
| 83 | 0 | *Pantoea* | *agglomerans* | Sc-1 | JF753355 |
| 84 | 0 | *Pantoea* | *agglomerans* | Sc-1 | JF753356 |
| 85 | 0 | *Pantoea* | *agglomerans* | Sc-1 | JF753357 |
| 86 | 173 | *Pantoea* | *agglomerans* | Sc-1 | JF753358 |
| 87 | 199 | *Pantoea* | *ananatis* | LMG 20103 | JF753359 |
| 88 | 0 | *Pantoea* | *ananatis* | LMG 20103 | JF753360 |
| 89 | 0 | *Pantoea* | *ananatis* | LMG 20103 | JF753361 |
| 90 | 0 | *Pantoea* | *ananatis* | LMG 20103 | JF753362 |
| 91 | 0 | *Pantoea* | *ananatis* | LMG 20103 | JF753363 |
| 92 | 0 | *Pantoea* | *ananatis* | LMG 20103 | JF753364 |
| 93 | 0 | *Pantoea* | *ananatis* | LMG 20103 | JF753365 |
| 94 | 0 | *Pantoea* | *ananatis* | LMG 20103 | JF753366 |
| 95 | 0 | *Pantoea* | *ananatis* | LMG 20106 | JF753367 |
| 96 | 158 | *Pantoea* | *ananatis* | SK-1 | JF753368 |
| 97 | 0 | *Pantoea* | *ananatis* | SK-1 | JF753369 |
| 98 | 0 | *Pantoea* | sp. | GJT-8 | JF753370 |
| 99 | 0 | *Pantoea* | sp. | GJT-8 | JF753371 |
| 100 | 0 | *Pantoea* | sp. | GJT-8 | JF753372 |
| 101 | 0 | *Pantoea* | sp. | GJT-8 | JF753373 |
| 102 | 0 | *Pantoea* | sp. | GJT-8 | JF753374 |
| 103 | 0 | *Pantoea* | sp. | GJT-8 | JF753375 |
| 104 | 0 | *Pantoea* | sp. | GJT-8 | JF753376 |
| 105 | 0 | *Pantoea* | sp. | GJT-8 | JF753377 |

TABLE 1-continued

Representative endophytes from grass seeds, including their 16S rRNA sequences, assignment within OTU numbers, Genus, species, strain information, as well as GenBank Accession numbers.

| SEQ ID NO. | OTU # | Genus | Species | Strain | Accession No. |
|---|---|---|---|---|---|
| 106 | 0 | Pantoea | sp. | GJT-8 | JF753378 |
| 107 | 0 | Pantoea | sp. | GJT-8 | JF753379 |
| 108 | 1 | Pseudomonas | fluorescens | | JF753380 |
| 109 | 2 | Pseudomonas | oleovarans | | JF753381 |
| 110 | 2 | Pseudomonas | oryzihabitans | | JF753382 |
| 111 | 10 | Strenotrophomonas | maltophilia | | JF753383 |
| 112 | 105 | Strenotrophomonas | maltophilia | | JF753384 |
| 113 | 40 | Strenotrophomonas | maltophilia | | JF753385 |
| 114 | 10 | Strenotrophomonas | maltophilia | | JF753386 |
| 115 | 10 | Strenotrophomonas | maltophilia | | JF753387 |
| 116 | 185 | Strenotrophomonas | maltophilia | | JF753388 |
| 117 | 10 | Strenotrophomonas | maltophilia | | JF753389 |
| 118 | 10 | Strenotrophomonas | maltophilia | | JF753390 |
| 119 | 10 | Strenotrophomonas | maltophilia | | JF753391 |
| 120 | 10 | Strenotrophomonas | maltophilia | | JF753392 |
| 121 | 10 | Strenotrophomonas | maltophilia | | JF753393 |
| 122 | 10 | Strenotrophomonas | maltophilia | | JF753394 |
| 123 | 10 | Strenotrophomonas | maltophilia | | JF753395 |
| 124 | 153 | Strenotrophomonas | maltophilia | | JF753396 |
| 125 | 10 | Strenotrophomonas | maltophilia | | JF753397 |
| 126 | 10 | Strenotrophomonas | maltophilia | | JF753398 |
| 127 | 86 | Uncultured bacterium | Uncultured bacterium | SP6-0 | JF753399 |
| 128 | 188 | Uncultured bacterium | Uncultured bacterium | X-50 | JF753400 |
| 129 | 84 | Pantoea | agglomerans | 1.2244 | JF753401 |
| 130 | 179 | Rhodococcus | fascians | | JF753402 |
| 131 | 2 | Pseudomonas | oryzihabitans | | JF753403 |
| 132 | 84 | Pantoea | agglomerans | 1.2244 | JF753404 |
| 133 | 18 | Escherichia | coli | NBRI1707 | JF753405 |
| 134 | 25 | Methylobacterium | radiotolerans | | JF753406 |
| 135 | 18 | Escherichia | coli | NBRI1707 | JF753407 |
| 136 | 18 | Enterobacter | sp. | TSSAS2-21 | JF753408 |
| 137 | 18 | Enterobacter | sp. | FMB-1 | JF753409 |
| 138 | 18 | Enterobacter | sp. | TSSAS2-21 | JF753410 |
| 139 | 101 | Sphingomonas | sp. | BF14 | JF753411 |
| 140 | 18 | Hafnia | alvei | | JF753412 |
| 141 | 149 | Escherichia | coli | NBRI1707 | JF753413 |
| 142 | 27 | Burkholderia | gladioli | pv. Agaricicola | JF753414 |
| 143 | 18 | Escherichia | coli | NBRI1707 | JF753415 |
| 144 | 25 | Methylobacterium | radiotolerans | | JF753416 |
| 145 | 194 | Micrococcus | luteus | NBSL29 | JF753417 |
| 146 | 37 | Burkholderia | phytofirmans | PsJN | JF753418 |
| 147 | 38 | Staphylococcus | warneri | R-36520 | JF753419 |
| 148 | 160 | Pseudomonas | fluorescens | | JF753420 |
| 149 | 18 | Enterobacter | cloacae | C111 | JF753421 |
| 150 | 161 | Methylobacterium | brachiatum | | JF753422 |
| 151 | 27 | Burkholderia | gladioli | pv. agaricicola | JF753423 |
| 152 | 18 | Escherichia | coli | NBRI1707 | JF753424 |
| 153 | 16 | Staphylococcus | sp. | SRC_DSF7 | JF753425 |
| 154 | 67 | Staphylococcus | epidermitis | | JF753426 |
| 155 | 64 | Methylobacterium | brachiatum | | JF753427 |
| 156 | 1 | Pseudomonas | putida | CM5002 | JF753428 |
| 157 | 37 | Burkholderia | phytofirmans | PsJN | JF753429 |
| 158 | 1 | Pseudomonas | putida | CM5002 | JF753430 |
| 159 | 101 | Sphingomonas | sp. | P5-5 | JF753431 |
| 160 | 84 | Pantoea | agglomerans | CLJ1 | JF753432 |
| 161 | 84 | Pantoea | agglomerans | KJPB2 | JF753433 |
| 162 | 7 | Pantoea | dispersa | CIP 102701 | JF753434 |
| 163 | 18 | Enterobacter | cloacae | R10-1A | JF753435 |
| 164 | 1 | Pseudomonas | putida | CM5002 | JF753436 |
| 165 | 1 | Pseudomonas | putida | CM5002 | JF753437 |
| 166 | 0 | Pantoea | agglomerans | KJPB2 | JF753438 |
| 167 | 143 | Pantoea | agglomerans | KJPB2 | JF753439 |
| 168 | 65 | Pseudomonas | putida | CM5002 | JF753440 |
| 169 | 1 | Pseudomonas | tolaasii | IExb | JF753441 |
| 170 | 84 | Pantoea | agglomerans | KJPB2 | JF753442 |
| 171 | 2 | Pseudomonas | oryzihabitans | | JF753443 |
| 172 | 1 | Pseudomonas | putida | CM5002 | JF753444 |
| 173 | 1 | Pseudomonas | putida | CM5002 | JF753445 |
| 174 | 143 | Pantoea | agglomerans | KJPB2 | JF753446 |
| 175 | 164 | Pantoea | agglomerans | KJPB2 | JF753447 |
| 176 | 56 | Enterobacter | asburiae | MY2 | JF753448 |
| 177 | 0 | Enterobacter | asburiae | NFSt10 | JF753449 |
| 178 | 25 | Methylobacterium | radiotolerans | | JF753450 |

TABLE 1-continued

Representative endophytes from grass seeds, including their 16S rRNA sequences, assignment within OTU numbers, Genus, species, strain information, as well as GenBank Accession numbers.

| SEQ ID NO. | OTU # | Genus | Species | Strain | Accession No. |
|---|---|---|---|---|---|
| 179 | 7 | Pantoea | dispersa | NCPPB 2285 | JF753451 |
| 180 | 1 | Pseudomonas | putida | CM5002 | JF753452 |
| 181 | 72 | Cellulomonas | denverensis | | JF753453 |
| 182 | 102 | Arthrobacter | ramosus | | JF753454 |
| 183 | 72 | Cellulomonas | denverensis | | JF753455 |
| 184 | 0 | Pantoea | ananatis | LMG 20103 | JF753456 |
| 185 | 0 | Pantoea | ananatis | LMG 20103 | JF753457 |
| 186 | 102 | Arthrobacter | sp. | XY9 | JF753458 |
| 187 | 0 | Enterobacter | asburiae | | JF753459 |
| 188 | 0 | Enterobacter | cloaceae | | JF753460 |
| 189 | 196 | Enterobacter | hormaechei | | JF753461 |
| 190 | 7 | Pantoea | dispersa | NCPPB 2285 | JF753462 |
| 191 | 0 | Enterobacter | cloacae | TU | JF753463 |
| 192 | 10 | Stenotrophomonas | maltophilia | | JF753464 |
| 193 | 10 | Stenotrophomonas | maltophilia | | JF753465 |
| 194 | 21 | Klebsiella | pneumoniae | 342 | JF753466 |
| 195 | 0 | Citrobacter | freundii | GM1 | JF753467 |
| 196 | 31 | Paenibacillus | caespitis | | JF753468 |
| 197 | 31 | Paenibacillus | graminis | | JF753469 |
| 198 | 178 | Paenibacillus | sp. | P117 | JF753470 |
| 199 | 178 | Paenibacillus | sp. | MK17 | JF753471 |
| 200 | 72 | Cellulomonas | denverensis | | JF753472 |
| 201 | 28 | Microbacterium | sp. | 13635I | JF753473 |
| 202 | 31 | Paenibacillus | caespitis | | JF753474 |
| 203 | 31 | Paenibacillus | caespitis | | JF753475 |
| 204 | 196 | Enterobacter | asburiae | J2S4 | JF753476 |
| 205 | 66 | Rhizobium | sp. | HGR13 | JF753477 |
| 206 | 84 | Pantoea | agglomerans | KJPB2 | JF753478 |
| 207 | 84 | Pantoea | agglomerans | KJPB2 | JF753479 |
| 208 | 84 | Pantoea | agglomerans | Sc-1 | JF753480 |
| 209 | 84 | Pantoea | agglomerans | KJPB2 | JF753481 |
| 210 | 1 | Pseudomonas | putida | CM5002 | JF753482 |
| 211 | 2 | Pseudomonas | sp. | TE9 | JF753483 |
| 212 | 84 | Pantoea | agglomerans | 1.2244 | JF753484 |
| 213 | 1 | Pseudomonas | synxantha | | JF753485 |
| 214 | 1 | Pseudomonas | fluorescens | | JF753486 |
| 215 | 1 | Pseudomonas | putida | CM5002 | JF753487 |
| 216 | 1 | Pseudomonas | fluorescens | PGPR1 | JF753488 |
| 217 | 0 | Pantoea | vagans | C9-1 | JF753489 |
| 218 | 10 | Stenotrophomonas | maltophilia | | JF753490 |
| 219 | 0 | Pantoea | agglomerans | 1.2244 | JF753491 |
| 220 | 37 | Burkholderia | phytofirmans | PSjN | JF753492 |
| 221 | 37 | Burkholderia | phytofirmans | PsJN | JF753493 |
| 222 | 92 | Streptomyces | sp. | KN-0260 | JF753494 |
| 223 | 64 | Methylobacterium | brachiatum | | JF753495 |
| 224 | 53 | Paenibacillus | sp. | IHB B 2257 | JF753496 |
| 225 | 0 | Pantoea | agglomerans | 1.2244 | JF753497 |
| 226 | 82 | Luteibacter | sp. | MDA0897 | JF753498 |
| 227 | 10 | Stenotrophomonas | maltophilia | | JF753499 |
| 228 | 7 | Pantoea | dispersa | NCPPB 2285 | JF753500 |
| 229 | 18 | Klebsiella | sp. | EH47 | JF753501 |
| 230 | 10 | Stenotrophomonas | maltophilia | | JF753502 |
| 231 | 10 | Stenotrophomonas | maltophilia | | JF753503 |
| 232 | 10 | Stenotrophomonas | maltophilia | | JF753504 |
| 233 | 10 | Stenotrophomonas | maltophilia | | JF753505 |
| 234 | 10 | Stenotrophomonas | maltophilia | | JF753506 |
| 235 | 0 | Pantoea | agglomerans | 1.2244 | JF753507 |
| 236 | 10 | Stenotrophomonas | maltophilia | | JF753508 |
| 237 | 192 | Enterobacter | asburiae | MY2 | JF753509 |
| 238 | 10 | Stenotrophomonas | maltophilia | | JF753510 |
| 239 | 22 | Bacillus | megaterium | NBAII-63 | JF753511 |
| 240 | 202 | Deinococcus | grandis | DSM | JF753512 |
| 241 | 204 | Azospirillum | zea | Gr24 | JF753513 |
| 242 | 30 | Rhodococcus | fascians | NKCM8906 | JF753514 |
| 243 | 28 | Microbacterium | sp. | VKM Ac-1389 | JF753515 |
| 244 | 41 | Bacillus | subtilis | | JF753516 |
| 245 | 41 | Bacillus | subtilis | TAT1-8 | JF753517 |
| 246 | 118 | Bacillus | asahai | NBPP91 | JF753518 |
| 247 | 64 | Methylobacterium | brachiatum | | JF753519 |
| 248 | 74 | Bradyrhizobium | japonicum | | JF753520 |
| 249 | 53 | Paenibacillus | sp. | IB-1067 | JF753521 |
| 250 | 120 | Paenibacillus | polymyxa | | JF753522 |
| 251 | 145 | Brevibacillus | agri | | JF753523 |
| 252 | 7 | Pantoea | agglomerans | ZFJ-6 | JF753524 |
| 253 | 56 | Enterobacter | sp. | pp9c | JF753525 |

TABLE 1-continued

Representative endophytes from grass seeds, including their 16S rRNA sequences, assignment within OTU numbers, Genus, species, strain information, as well as GenBank Accession numbers.

| SEQ ID NO. | OTU # | Genus | Species | Strain | Accession No. |
|---|---|---|---|---|---|
| 254 | 110 | Sediminibacterium | sp. | I-28 | JF753526 |
| 255 | 200 | Bacillus | pumilus | ustb-06 | JF753527 |
| 256 | 39 | Bacillus | pumilus | PhyCEm-115 | JF753528 |
| 257 | 76 | Bacillus | circulans | WZ12 | JF753529 |
| 258 | 76 | Bacillus | nealsonii | PAB1C3 | JF753530 |
| 259 | 7 | Pantoea | agglomerans | ZFJ-6 | JF753531 |
| 260 | 39 | Bacillus | pumilus | CT3 | JF753532 |
| 261 | 18 | Enterobacter | sp. | G-2-10-2 | JF753533 |
| 262 | 7 | Pantoea | agglomerans | BJTZ1 | JF753534 |
| 263 | 120 | Paenibacillus | polymyxa | | JF753535 |
| 264 | 119 | Enterococcus | gallinarum | | JF753536 |
| 265 | 0 | Enterobacter | asburiae | M16 | JF753537 |
| 266 | 56 | Pantoea | agglomerans | WAB1925 | JF753538 |
| 267 | 113 | Microbacterium | schleiferi | | JF753539 |
| 268 | 71 | Sediminibacterium | sp. | I-28 | JF753540 |
| 269 | 119 | Enterococcus | gallinarum | | JF753541 |
| 270 | 64 | Methylobacterium | brachiatum | | JF753542 |
| 271 | 0 | Enterobacter | cloacae | M-5 | JF753543 |
| 272 | 39 | Bacillus | pumilus | CT3 | JF753544 |
| 273 | 56 | Enterobacter | cloacae | | JF753545 |
| 274 | 0 | Enterobacter | cloacae | M-5 | JF753546 |
| 275 | 0 | Enterobacter | cloacae | M-5 | JF753547 |
| 276 | 50 | Enterobacter | hormaechei | skg0061 | JF753548 |
| 277 | 170 | Pantoea | sp. | | JF753549 |
| 278 | 64 | Methylobacterium | brachiatum | | JF753550 |
| 279 | 106 | Enterobacter | asburiae | M16 | JF753551 |
| 280 | 176 | Bacillus | pumilus | NBJ7 | JF753552 |
| 281 | 1 | Pseudomonas | protegens | CHA0 | JN110435 |
| 282 | 10 | Stenotrophomonas | maltophilia | IAM 12423 | JN110431 |
| 283 | 10 | Stenotrophomonas | maltophilia | IAM 12423 | JN110437 |
| 284 | 9 | Ochrobactrum | tritici | SCII 24 | JN110432 |
| 285 | 9 | Ochrobactrum | grignonense | OgA9a | JN110441 |
| 286 | 46 | Sphingomonas | yanoikuyae | IFO 15102 | JN110436 |
| 287 | 104 | Flavobacterium | johnsoniae | DSM 2064 | JN110440 |
| 288 | 24 | Paenibacillus | humicus | PC-147 | JN110433 |
| 289 | 169 | Agromyces | mediolanus | DSM 20152 | JN110439 |
| 290 | 3 | Curtobacterium | citreum | DSM 20528 | JN110438 |
| 291 | 3 | Curtobacterium | herbarum | DSM 14013 | JN110445 |
| 292 | 121 | Frigoribacterium | faeni | DSM 10309 | JN110443 |
| 293 | 134 | Microbacterium | oleivorans | DSM 16091 | JN110444 |
| 294 | 142 | Mycobacterium | abscessus | CIP 104536 | JN110430 |
| 295 | 142 | Mycobacterium | abscessus | CIP 104536 | JN110434 |
| 296 | 201 | Plantibacter | flavus | DSM 14012 | JN110442 |
| 297 | 83 | Enterobacter | cloacae subsp. cloacae | ATCC 13047 | JN110446 |
| 298 | 2 | Pseudomonas | oryzihabitans | IAM 1568 | JN110447 |
| 299 | 193 | Aeromonas | hydrophila subsp. dhakensis | LMG 19562 | JN110448 |
| 300 | 180 | Herbaspirillum | rubrisubalvicans | ICMP 5777T | JN110449 |
| 301 | 23 | Acinetobacter | beijerinckii | LUH 4759 | JN110450 |
| 302 | 66 | Rhizobium | radiobacter | IAM 12048 | JN110451 |
| 303 | 18 | Enterobacter | arachidis | Ah-143 | JN110452 |
| 304 | 83 | Escherichia | coli | O111:H str. 11128 | JN110453 |
| 305 | 10 | Stenotrophomonas | maltophilia | IAM 12423 | JN110454 |
| 306 | 84 | Pantoea | agglomerans | DSM3493 | JN110455 |
| 307 | 63 | Neisseria | meningitidis | M01-240149 | JN110456 |
| 308 | 1 | Pseudomonas | protegens | CHA0 | JN110457 |
| 309 | 89 | Dyella | ginsengisoli | Gsoil 3046 | JN110458 |
| 310 | 2 | Pseudomonas | putida | BIRD-1 | JN110459 |
| 311 | 19 | Bacillus | psychrosaccharolyticus | S156 | JN110460 |
| 312 | 129 | Deinococcus | ficus | CC-FR2-10 | JN110461 |
| 313 | 13 | Achromobacter | spanius | LMG 5911 | JN110462 |
| 314 | 0 | Tatumella | morbirosei | | JN167639 |
| 315 | 56 | Leclercia | adecarboxylata | | JN167641 |
| 316 | 18 | Enterobacter | dissolvens | | JN167642 |
| 317 | 56 | Enterobacter | cancerogenus | | JN167646 |
| 318 | 21 | Serratia | marcescens | | JN167643 |
| 319 | 0 | Erwinia | cypripedi | | JN167644 |
| 320 | 7 | Erwinia | aphidicola | | JN167651 |
| 321 | 46 | Sphingomonas | yanoikuyae | | JN167645 |
| 322 | 0 | Pantoea | anthophila | | JN167647 |
| 323 | 7 | Pantoea | dispersa | | JN167640 |
| 324 | 15 | Oxalophagus | oxalicus | | JN167648 |
| 325 | 14 | Paenibacillus | nanensis | | JN167650 |

TABLE 1-continued

Representative endophytes from grass seeds, including their 16S rRNA sequences, assignment within OTU numbers, Genus, species, strain information, as well as GenBank Accession numbers.

| SEQ ID NO. | OTU # | Genus | Species | Strain | Accession No. |
|---|---|---|---|---|---|
| 326 | 5 | Bosea | vestrisii | | JN167652 |
| 327 | 69 | Rheinheimera | soli | | JN167653 |
| 328 | 26 | Acinetobacter | baumannii | | JN167654 |
| 329 | 23 | Acinetobacter | johnsonii | | JN167660 |
| 330 | 208 | Acinetobacter | beijerinckii | | JN167680 |
| 331 | 208 | Acinetobacter | schindleri | | JN167685 |
| 332 | 116 | Roseateles | depolymerans | | JN167655 |
| 333 | 116 | Roseateles | terrae | | JN167663 |
| 334 | 27 | Burkholderia | diffusa | | JN167657 |
| 335 | 211 | Sphingopyxis | panaciterrae | | JN167658 |
| 336 | 98 | Massilia | aerolata | | JN167682 |
| 337 | 51 | Massilia | albidiflava | | JN167661 |
| 338 | 1 | Pseudomonas | poae | | JN167662 |
| 339 | 75 | Ancylobacter | rudongensis | | JN167664 |
| 340 | 10 | Stenotrophomonas | pavanii | | JN167665 |
| 341 | 83 | Shigella | flexneri | | JN167666 |
| 342 | 91 | Bdellovibrio | bacteriovorus | | JN167671 |
| 343 | 56 | Enterobacter | cancerogenus | | JN167674 |
| 344 | 130 | Enhydrobacter | aerosaccus | | JN167675 |
| 345 | 100 | Variovorax | | boronicumulans | JN167676 |
| 346 | 128 | Oceanibaculum | pacificum | | JN167677 |
| 347 | 46 | Sphingomonas | yanoikuyae | | JN167683 |
| 348 | 157 | Devosia | riboflavina | | JN167684 |
| 349 | 18 | Escherichia | coli | | JN167686 |
| 350 | 190 | Sphingosinicella | | xenopeptidilytica | JN167688 |
| 351 | 120 | Paenibacillus | daejeonensis | | JN167679 |
| 352 | 6 | Paenibacillus | xylanilyticus | | JN167687 |
| 353 | 163 | Sediminibacillus | halophilus | | JN167689 |
| 354 | 44 | Corynebacterium | | pseudogenitalium | JN167659 |
| 355 | 123 | Nocardia | soli | | JN167670 |
| 356 | 206 | Lentzea | flaviverrucosa | | JN167672 |
| 357 | 198 | Flavobacterium | degerlachei | | JN167656 |
| 358 | 165 | Flavobacterium | aquatile | | JN167669 |
| 359 | 62 | Chryseobacterium | hominis | | JN167678 |
| 360 | 186 | Uncultured bacterium | | Uncultured bacterium | JN167667 |
| 361 | 195 | Uncultured bacterium | | Uncultured bacterium | JN167681 |
| 362 | 21 | Klebsiella | variicola | | JN167690 |
| 363 | 18 | Klebsiella | pneumoniae | | JN167691 |
| 364 | 1 | Pseudomonas | plecoglossicida | | JN167693 |
| 365 | 10 | Stenotrophomonas | pavanii | | JN167694 |
| 366 | 101 | Sphingomonas | echinoides | | JN167695 |
| 367 | 66 | Rhizobium | massiliae | | JN167696 |
| 368 | 0 | Serratia | marcescens | | JN167697 |
| 369 | 101 | Sphingomonas | echinoides | | JN167698 |
| 370 | 114 | Sphingomonas | dokdonensis | | JN167701 |
| 371 | 7 | Pantoea | dispersa | | JN167699 |
| 372 | 82 | Luteibacter | anthropi | | JN167700 |
| 373 | 27 | Burkholderia | gladioli | | JN167702 |
| 374 | 56 | Leclercia | adecarboxylata | | JN167703 |
| 375 | 167 | Tepidimonas | aquatic | | JN167705 |
| 376 | 0 | Tatumella | morbirosei | | JN167706 |
| 377 | 56 | Enterobacter | cancerogenus | | JN167707 |
| 378 | 124 | Thermomonas | brevis | | JN167708 |
| 379 | 79 | Lactobacillus | iners | | JN167704 |
| 380 | 7 | Pantoea | dispersa | | JN167709 |
| 381 | 101 | Sphingomonas | echinoides | | JN167710 |
| 382 | 7 | Pantoea | dispersa | | JN167784 |
| 383 | 84 | Pantoea | agglomerans | | JN167785 |
| 384 | 101 | Sphingomonas | echinoides | | JN167786 |
| 385 | 101 | Sphingomonas | echinoides | | JN167713 |
| 386 | 18 | Shigella | flexneri | | JN167714 |
| 387 | 0 | Leclercia | adecarboxylata | | JN167716 |
| 388 | 29 | Pseudoxanthomonas | kaohsiungensis | | JN167717 |
| 389 | 57 | Psychrobacter | pulmonis | | JN167718 |
| 390 | 100 | Variovorax | | boronicumulans | JN167720 |
| 391 | 56 | Enterobacter | sp. | | JN167721 |
| 392 | 181 | Microvirga | aerophilus | | JN167727 |
| 393 | 132 | Microvirga | aerilata | | JN167734 |
| 394 | 7 | Erwinia | aphidicola | | JN167725 |
| 395 | 162 | Methylobacterium | platani | | JN167729 |
| 396 | 0 | Tatumella | morbirosei | | JN167730 |
| 397 | 37 | Burkholderia | phytofirmans | | JN167732 |
| 398 | 27 | Burkholderia | sp. | | JN167723 |

TABLE 1-continued

Representative endophytes from grass seeds, including their 16S rRNA sequences, assignment within OTU numbers, Genus, species, strain information, as well as GenBank Accession numbers.

| SEQ ID NO. | OTU # | Genus | Species | Strain | Accession No. |
|---|---|---|---|---|---|
| 399 | 36 | Acidovorax | temperans | | JN167733 |
| 400 | 0 | Serratia | marcescens | | JN167743 |
| 401 | 56 | Serratia | ureilytica | | JN167737 |
| 402 | 23 | Acinetobacter | beijerinckii | | JN167738 |
| 403 | 26 | Acinetobacter | junii | | JN167739 |
| 404 | 23 | Acinetobacter | johnsonii | | JN167724 |
| 405 | 23 | Acinetobacter | kyonggiensis | | JN167726 |
| 406 | 152 | Halomonas | daqingensis | | JN167741 |
| 407 | 7 | Pantoea | dispersa | | JN167736 |
| 408 | 79 | Lactobacillus | iners | | JN167712 |
| 409 | 22 | Bacillus | aryabhattai | | JN167715 |
| 410 | 67 | Staphylococcus | hominis | | JN167722 |
| 411 | 67 | Staphylococcus | capitis | | JN167728 |
| 412 | 85 | Finegoldia | magna | | JN167735 |
| 413 | 20 | Ruminococcus | bromii | | JN167740 |
| 414 | 42 | Aerococcus | urinaeequi | | JN167742 |
| 415 | 32 | Propioniciclava | tarda | | JN167711 |
| 416 | 70 | Propionibacterium | acnes | | JN167719 |
| 417 | 107 | | Uncultured bacterium | | JN167731 |
| 418 | 99 | Brevundimonas | diminuta | | JN167744 |
| 419 | 99 | Brevundimonas | | naejangsanensis | JN167764 |
| 420 | 101 | Sphingomonas | echinoides | | JN167745 |
| 421 | 126 | Sphingomonas | koreensis | | JN167756 |
| 422 | 191 | Sphingomonas | humi | | JN167758 |
| 423 | 100 | Acidovorax | facilis | | JN167746 |
| 424 | 36 | Acidovorax | temperans | | JN167757 |
| 425 | 136 | Shinella | zoogloeoides | | JN167747 |
| 426 | 116 | Roseateles | depolymerans | | JN167748 |
| 427 | 116 | Roseateles | terrae | | JN167752 |
| 428 | 69 | Rheinheimera | chironomi | | JN167749 |
| 429 | 69 | Rheinheimera | soli | | JN167775 |
| 430 | 23 | Acinetobacter | johnsonii | | JN167750 |
| 431 | 208 | Acinetobacter | schindleri | | JN167761 |
| 432 | 23 | Acinetobacter | lwoffii | | JN167765 |
| 433 | 2 | Pseudomonas | stutzeri | | JN167751 |
| 434 | 184 | Thermomonas | koreensis | | JN167753 |
| 435 | 27 | Burkholderia | sp. | | JN167754 |
| 436 | 18 | Shigella | flexneri | | JN167760 |
| 437 | 97 | Cellvibrio | mixtus | | JN167766 |
| 438 | 21 | Serratia | marcescens | | JN167767 |
| 439 | 131 | Thiobacillus | aquaesulis | | JN167768 |
| 440 | 133 | Luteimonas | aestuarii | | JN167769 |
| 441 | 197 | Sphingosinicella | sp. | | JN167772 |
| 442 | 108 | Acidithiobacillus | albertensis | | JN167773 |
| 443 | 36 | Curvibacter | gracilis | | JN167774 |
| 444 | 47 | Devosia | insulae | | JN167777 |
| 445 | 93 | Cupriavidus | gilardii | | JN167778 |
| 446 | 140 | Methylobacterium | rhodesianum | | JN167779 |
| 447 | 89 | Dokdonella | sp. | | JN167780 |
| 448 | 150 | Desemzia | incerta | | JN167763 |
| 449 | 68 | Kocuria | rosea | | JN167770 |
| 450 | 123 | Nocardia | ignorata | | JN167771 |
| 451 | 182 | Pseudonocardia | aurantiaca | | JN167776 |
| 452 | 104 | Flavobacterium | johnsoniae | | JN167755 |
| 453 | 203 | Flavobacterium | mizutaii | | JN167762 |
| 454 | 73 | Flavisolibacter | ginsengiterrae | | JN167781 |
| 455 | 33 | Sphingobacterium | daejeonense | | JN167759 |
| 456 | 0 | Leclercia | adecarboxylata | | JN167782 |
| 457 | 56 | Enterobacter | cancerogenus | | JN167783 |
| 458 | 39 | Bacillus | altitudinis | | HQ432811 |
| 459 | 19 | Bacillus | simplex | | HQ432812 |
| 460 | 12 | Bacillus | thuringiensis | | HQ432813 |
| 461 | 6 | Paenibacillus | amylolyticus | | HQ432814 |
| 462 | 103 | Staphylococcus | | aureus subsp. aureus | HQ432815 |
| 463 | 146 | Pantoea | ananatis | | AB178169 |
| 464 | 56 | Pantoea | ananatis | | AB178170 |
| 465 | 12 | Bacillus | cereus | | AB178171 |
| 466 | 59 | Pantoea | ananatis | | AB178172 |
| 467 | 12 | Bacillus | cereus | | AB178173 |
| 468 | 45 | Sphingomonas | echinoides | | AB178174 |
| 469 | 45 | Sphingomonas | echinoides | | AB178175 |
| 470 | 45 | Sphingomonas | echinoides | | AB178176 |
| 471 | 45 | Sphingomonas | | parapaucimobilis | AB178177 |
| 472 | 12 | Bacillus | cereus | | AB178178 |
| 473 | 12 | Bacillus | cereus | | AB178179 |

TABLE 1-continued

Representative endophytes from grass seeds, including their 16S rRNA sequences, assignment within OTU numbers, Genus, species, strain information, as well as GenBank Accession numbers.

| SEQ ID NO. | OTU # | Genus | Species | Strain | Accession No. |
|---|---|---|---|---|---|
| 474 | 12 | Bacillus | cereus | | AB178192 |
| 475 | 12 | Bacillus | cereus | | AB178193 |
| 476 | 12 | Bacillus | cereus | | AB178194 |
| 477 | 12 | Bacillus | cereus | | AB178195 |
| 478 | 12 | Bacillus | cereus | | AB178196 |
| 479 | 12 | Bacillus | cereus | | AB178197 |
| 480 | 12 | Bacillus | cereus | | AB178198 |
| 481 | 12 | Bacillus | cereus | | AB178199 |
| 482 | 12 | Bacillus | cereus | | AB178200 |
| 483 | 12 | Bacillus | cereus | | AB178201 |
| 484 | 12 | Bacillus | cereus | | AB178214 |
| 485 | 12 | Bacillus | cereus | | AB178215 |
| 486 | 12 | Bacillus | cereus | | AB178216 |
| 487 | 12 | Bacillus | cereus | | AB178217 |
| 488 | 12 | Bacillus | cereus | | AB178218 |
| 489 | 29 | Xanthomonas | translucens | pv. poae | AB242936 |
| 490 | 7 | Pantoea | ananatis | | AB242937 |
| 491 | 7 | Pantoea | ananatis | | AB242938 |
| 492 | 8 | Methylobacterium | aquaticum | | AB242939 |
| 493 | 8 | Methylobacterium | aquaticum | | AB242940 |
| 494 | 172 | Sphingomonas | melonis | | AB242941 |
| 495 | 45 | Sphingomonas | yabuuchiae | | AB242942 |
| 496 | 45 | Sphingomonas | yabuuchiae | | AB242943 |
| 497 | 8 | Methylobacterium | aquaticum | | AB242944 |
| 498 | 7 | Pantoea | ananatis | | AB242945 |
| 499 | 7 | Pantoea | ananatis | | AB242946 |
| 500 | 41 | Bacillus | subtilis | | AB242958 |
| 501 | 41 | Bacillus | subtilis | | AB242959 |
| 502 | 41 | Bacillus | subtilis | | AB242960 |
| 503 | 41 | Bacillus | subtilis | | AB242961 |
| 504 | 39 | Bacillus | pumilus | | AB242962 |
| 505 | 59 | Micrococcus | luteus | | AB242963 |
| 506 | 45 | Sphingomonas | yabuuchiae | | AB242964 |
| 507 | 148 | Sphingomonas | yabuuchiae | | AB242965 |
| 508 | 212 | Acidovorax | sp. | | AB242966 |
| 509 | 3 | Curtobacterium | flaccumfaciens | pv. Basellae | AB242967 |
| 510 | 6 | Paenibacillus | amylolyticus | | AB242978 |
| 511 | 146 | Pantoea | ananatis | | AB242979 |
| 512 | 77 | Pantoea | ananatis | | AB242980 |
| 513 | 39 | Bacillus | pumilus | | AB242981 |
| 514 | 77 | Pantoea | ananatis | | AB242982 |
| 515 | 29 | Xanthomonas | translucens | | AB242983 |
| 516 | 39 | Bacillus | pumilus | | AB242984 |
| 517 | 3 | Curtobacterium | flaccumfaciens | pv. Basellae | AB242985 |
| 518 | 29 | Xanthomonas | translucens | pv. poae | AB242986 |
| 519 | 39 | Bacillus | pumilus | | AB242987 |
| 520 | 29 | Xanthomonas | translucens | pv. poae | AB242988 |

TABLE 2

Endophytic bacteria isolated from corn, rice and wheat seeds, including assignment to specific OTUs, corresponding Sequence ID numbers, Family, Genus, Taxonomic information and plant source from which the microbe was derived.

| SYM # | OTU# | SEQ ID NO: | Seed Crop Type | Seed Cultivar Type | Source of seed microbes | Family of Seed Microbe | Taxonomy of Seed Microbe |
|---|---|---|---|---|---|---|---|
| SYM00033 | 0 | 541 | Teosinte | Wild relative | Surface sterilized seeds | Enterobacteriaceae | Enterobacter sp. |
| SYM00173 | 0 | 593 | Rice | Modern | Surface sterilized seeds | Enterobacteriaceae | Pantoea sp. |
| SYM00176 | 0 | 596 | Oryza nivara | Wild relative | Surface sterilized seeds | Enterobacteriaceae | Pantoea sp. |
| SYM00284 | 0 | 633 | Maize | Modern | Surface sterilized seeds | Enterobacteriaceae | Pantoea ananatis |
| SYM00605 | 0 | 716 | Maize | Modern | Seed surface wash | Enterobacteriaceae | |
| SYM00607 | 0 | 717 | Maize | Modern | Seed surface wash | Enterobacteriaceae | |
| SYM00608 | 0 | 718 | Maize | Modern | Seed surface wash | Enterobacteriaceae | Pantoea sp. |
| SYM00620 | 0 | 720 | Teosinte | Wild relative | Seed surface wash | Enterobacteriaceae | Enterobacter sp. |
| SYM00658 | 0 | 736 | Avena sterilis | Wild relative | Seed surface wash | Enterobacteriaceae | |
| SYM00985 | 0 | 851 | Rice | Modern | Surface sterilized seeds | Enterobacteriaceae | |
| SYM01006 | 0 | 866 | Rice | Modern | Surface sterilized seeds | Enterobacteriaceae | |
| SYM01035 | 0 | 887 | Avena sterilis | Wild relative | Surface sterilized seeds | Enterobacteriaceae | |
| SYM01041 | 0 | 892 | Rice | Ancient Landrace | Surface sterilized seeds | Enterobacteriaceae | Pantoea sp. |
| SYM01158 | 0 | 937 | Avena sterilis | Wild relative | Roots & Seeds | Enterobacteriaceae | |
| SYM01173 | 0 | 943 | Rice | Ancient Landrace | Roots & Seeds | Enterobacteriaceae | |
| SYM01231 | 0 | 980 | Rice | Modern | Roots & Seeds | Enterobacteriaceae | |

TABLE 2-continued

Endophytic bacteria isolated from corn, rice and wheat seeds, including assignment to specific OTUs, corresponding Sequence ID numbers, Family, Genus, Taxonomic information and plant source from which the microbe was derived.

| SYM # | OTU# | SEQ ID NO: | Seed Crop Type | Seed Cultivar Type | Source of seed microbes | Family of Seed Microbe | Taxonomy of Seed Microbe |
|---|---|---|---|---|---|---|---|
| SYM00472 | 1 | 636 | Maize | Modern | Roots | Pseudomonadaceae | *Pseudomonas* sp. |
| SYM00660 | 1 | 737 | *Avena sterilis* | Wild relative | Seed surface wash | Pseudomonadaceae | *Pseudomonas* sp. |
| SYM00011 | 2 | 522 | Teosinte | Wild relative | Surface sterilized seeds | Pseudomonadaceae | *Pseudomonas* sp. |
| SYM00011b | 2 | 523 | Teosinte | Wild relative | Surface sterilized seeds | Pseudomonadaceae | *Pseudomonas* sp. |
| SYM00013 | 2 | 524 | Teosinte | Wild relative | Surface sterilized seeds | Pseudomonadaceae | *Pseudomonas* sp. |
| SYM00014 | 2 | 526 | Teosinte | Wild relative | Surface sterilized seeds | Pseudomonadaceae | *Pseudomonas* sp. |
| SYM00062 | 2 | 557 | Teosinte | Wild relative | Surface sterilized seeds | Pseudomonadaceae | *Pseudomonas* sp. |
| SYM00067 | 2 | 562 | Teosinte | Wild relative | Surface sterilized seeds | Pseudomonadaceae | *Pseudomonas* sp. |
| SYM00068 | 2 | 563 | Teosinte | Wild relative | Surface sterilized seeds | Pseudomonadaceae | *Pseudomonas* sp. |
| SYM00069 | 2 | 564 | Teosinte | Wild relative | Surface sterilized seeds | Pseudomonadaceae | *Pseudomonas* sp. |
| SYM00646 | 2 | 730 | Rice | Modern | Seed surface wash | Pseudomonadaceae | *Pseudomonas* sp. |
| SYM00649 | 2 | 733 | Rice | Modern | Seed surface wash | Pseudomonadaceae | *Pseudomonas* sp. |
| SYM00650 | 2 | 734 | Rice | Modern | Seed surface wash | Pseudomonadaceae | *Pseudomonas* sp. |
| SYM00657 | 2 | 735 | *Avena sterilis* | Wild relative | Seed surface wash | Pseudomonadaceae | *Pseudomonas* sp. |
| SYM00672 | 2 | 738 | *Oryza latifolia* | Wild relative | Seed surface wash | Pseudomonadaceae | *Pseudomonas* sp. |
| SYM00709 | 2 | 747 | Rice | Modern | Seed surface wash | Pseudomonadaceae | *Pseudomonas* sp. |
| SYM00926 | 2 | 804 | Rice | Ancient Landrace | Surface sterilized seeds | Pseudomonadaceae | *Pseudomonas* sp. |
| SYM00927 | 2 | 805 | Rice | Ancient Landrace | Surface sterilized seeds | Pseudomonadaceae | *Pseudomonas* sp. |
| SYM00946 | 2 | 821 | Rice | Modern | Surface sterilized seeds | Pseudomonadaceae | *Pseudomonas* sp. |
| SYM00955 | 2 | 828 | Rice | Ancient Landrace | Surface sterilized seeds | Pseudomonadaceae | *Pseudomonas* sp. |
| SYM00970 | 2 | 839 | Rice | Ancient Landrace | Surface sterilized seeds | Pseudomonadaceae | *Pseudomonas* sp. |
| SYM00971 | 2 | 840 | Rice | Ancient Landrace | Surface sterilized seeds | Pseudomonadaceae | *Pseudomonas* sp. |
| SYM00973 | 2 | 842 | Rice | Ancient Landrace | Surface sterilized seeds | Pseudomonadaceae | *Pseudomonas* sp. |
| SYM00993 | 2 | 857 | *Oryza officinalis* | Wild relative | Surface sterilized seeds | Pseudomonadaceae | *Pseudomonas* sp. |
| SYM01007 | 2 | 867 | Rice | Modern | Surface sterilized seeds | Pseudomonadaceae | *Pseudomonas* sp. |
| SYM01024 | 2 | 880 | *Oryza nivara* | Wild relative | Surface sterilized seeds | Pseudomonadaceae | *Pseudomonas* sp. |
| SYM01032 | 2 | 885 | *Avena sterilis* | Wild relative | Surface sterilized seeds | Pseudomonadaceae | *Pseudomonas* sp. |
| SYM01036 | 2 | 888 | Rice | Modern | Surface sterilized seeds | Pseudomonadaceae | *Pseudomonas* sp. |
| SYM01164 | 2 | 940 | Rice | Ancient Landrace | Roots & Seeds | Pseudomonadaceae | *Pseudomonas* sp. |
| SYM01171 | 2 | 942 | Rice | Ancient Landrace | Roots & Seeds | Pseudomonadaceae | *Pseudomonas* sp. |
| SYM01177 | 2 | 947 | Rice | Ancient Landrace | Roots & Seeds | Pseudomonadaceae | *Pseudomonas* sp. |
| SYM01178 | 2 | 948 | Rice | Ancient Landrace | Roots & Seeds | Pseudomonadaceae | *Pseudomonas* sp. |
| SYM01225 | 2 | 975 | Rice | Modern | Roots & Seeds | Pseudomonadaceae | *Pseudomonas* sp. |
| SYM01245 | 2 | 988 | Rice | Ancient Landrace | Roots & Seeds | Pseudomonadaceae | *Pseudomonas* sp. |
| SYM01251 | 2 | 989 | Rice | Ancient Landrace | Roots & Seeds | Pseudomonadaceae | *Pseudomonas* sp. |
| SYM01254 | 2 | 990 | Rice | Ancient Landrace | Roots & Seeds | Pseudomonadaceae | *Pseudomonas* sp. |
| SYM00013b | 3 | 525 | Teosinte | Wild relative | Surface sterilized seeds | Microbacteriaceae | *Curtobacterium* sp. |
| SYM00167 | 3 | 588 | Rice | Modern | Surface sterilized seeds | Microbacteriaceae | *Curtobacterium* sp. |
| SYM00171 | 3 | 591 | Rice | Modern | Surface sterilized seeds | Microbacteriaceae | *Curtobacterium* sp. |
| SYM00174 | 3 | 594 | Rye | Modern | Surface sterilized seeds | Microbacteriaceae | *Curtobacterium* sp. |
| SYM00178 | 3 | 598 | Rice | Ancient Landrace | Surface sterilized seeds | Microbacteriaceae | *Curtobacterium* sp. |
| SYM00180 | 3 | 600 | Rice | Ancient Landrace | Surface sterilized seeds | Microbacteriaceae | *Curtobacterium* sp. |
| SYM00181 | 3 | 601 | Rice | Ancient Landrace | Surface sterilized seeds | Microbacteriaceae | *Curtobacterium* sp. |
| SYM00235 | 3 | 622 | Rice | Modern | Surface sterilized seeds | Microbacteriaceae | *Curtobacterium* sp. |
| SYM00244 | 3 | 626 | Barley | Modern | Surface sterilized seeds | Microbacteriaceae | *Curtobacterium* sp. |
| SYM00525 | 3 | 654 | *Oryza nivara* | Wild relative | Seed surface wash | Microbacteriaceae | *Curtobacterium* sp. |
| SYM00625 | 3 | 724 | Maize | Modern | Seed surface wash | Microbacteriaceae | *Curtobacterium* sp. |
| SYM00645 | 3 | 729 | Rice | Modern | Seed surface wash | Microbacteriaceae | *Curtobacterium* sp. |
| SYM00647 | 3 | 731 | Rice | Modern | Seed surface wash | Microbacteriaceae | *Curtobacterium* sp. |
| SYM00673b | 3 | 739 | *Oryza latifolia* | Wild relative | Seed surface wash | Microbacteriaceae | *Curtobacterium* sp. |
| SYM00690 | 3 | 740 | Rice | Modern | Seed surface wash | Microbacteriaceae | *Curtobacterium* sp. |
| SYM00691 | 3 | 741 | Rice | Modern | Seed surface wash | Microbacteriaceae | *Curtobacterium* sp. |
| SYM00693 | 3 | 742 | Rice | Modern | Seed surface wash | Microbacteriaceae | *Curtobacterium* sp. |
| SYM00694b | 3 | 744 | Rice | Modern | Seed surface wash | Microbacteriaceae | *Curtobacterium* sp. |
| SYM00712 | 3 | 748 | Rice | Modern | Seed surface wash | Microbacteriaceae | *Curtobacterium* sp. |
| SYM00716 | 3 | 752 | Rice | Ancient Landrace | Seed surface wash | Microbacteriaceae | *Curtobacterium* sp. |
| SYM00722 | 3 | 753 | Rice | Ancient Landrace | Seed surface wash | Microbacteriaceae | *Curtobacterium* sp. |
| SYM00722B | 3 | 754 | Rice | Ancient Landrace | Seed surface wash | Microbacteriaceae | *Curtobacterium* sp. |
| SYM00731B | 3 | 756 | Rice | Ancient Landrace | Seed surface wash | Microbacteriaceae | *Curtobacterium* sp. |
| SYM00749 | 3 | 758 | Rice | Ancient Landrace | Surface sterilized seeds | Microbacteriaceae | *Curtobacterium* sp. |
| SYM00784 | 3 | 773 | Maize | Modern | Seed surface wash | Microbacteriaceae | *Curtobacterium* sp. |
| SYM00947 | 3 | 822 | Rice | Modern | Surface sterilized seeds | Microbacteriaceae | *Curtobacterium* sp. |
| SYM00949 | 3 | 823 | Rice | Modern | Surface sterilized seeds | Microbacteriaceae | *Curtobacterium* sp. |
| SYM00952 | 3 | 826 | Rice | Ancient Landrace | Surface sterilized seeds | Microbacteriaceae | *Curtobacterium* sp. |
| SYM00964 | 3 | 834 | Rice | Ancient Landrace | Surface sterilized seeds | Microbacteriaceae | *Curtobacterium* sp. |
| SYM00976 | 3 | 844 | Rice | Ancient Landrace | Surface sterilized seeds | Microbacteriaceae | *Curtobacterium* sp. |
| SYM00980 | 3 | 847 | Rice | Modern | Surface sterilized seeds | Microbacteriaceae | *Curtobacterium* sp. |
| SYM00984 | 3 | 850 | Rice | Modern | Surface sterilized seeds | Microbacteriaceae | *Curtobacterium* sp. |
| SYM00996 | 3 | 859 | *Oryza officinalis* | Wild relative | Surface sterilized seeds | Microbacteriaceae | *Curtobacterium* sp. |
| SYM01013 | 3 | 872 | Rice | Ancient Landrace | Surface sterilized seeds | Microbacteriaceae | *Curtobacterium* sp. |
| SYM01022 | 3 | 879 | *Oryza nivara* | Wild relative | Surface sterilized seeds | Microbacteriaceae | *Curtobacterium* sp. |
| SYM01025 | 3 | 881 | *Oryza nivara* | Wild relative | Surface sterilized seeds | Microbacteriaceae | *Curtobacterium* sp. |
| SYM01142 | 3 | 928 | Rice | Modern | Roots & Seeds | Microbacteriaceae | *Curtobacterium* sp. |
| SYM01144 | 3 | 929 | Rice | Modern | Roots & Seeds | Microbacteriaceae | *Curtobacterium* sp. |

TABLE 2-continued

Endophytic bacteria isolated from corn, rice and wheat seeds, including assignment to specific OTUs, corresponding Sequence ID numbers, Family, Genus, Taxonomic information and plant source from which the microbe was derived.

| SYM # | OTU# | SEQ ID NO: | Seed Crop Type | Seed Cultivar Type | Source of seed microbes | Family of Seed Microbe | Taxonomy of Seed Microbe |
|---|---|---|---|---|---|---|---|
| SYM01148 | 3 | 931 | Rice | Modern | Roots & Seeds | Microbacteriaceae | *Curtobacterium* sp. |
| SYM01151 | 3 | 932 | Rice | Modern | Roots & Seeds | Microbacteriaceae | *Curtobacterium* sp. |
| SYM01155 | 3 | 935 | Rice | Modern | Roots & Seeds | Microbacteriaceae | *Curtobacterium* sp. |
| SYM01156 | 3 | 936 | Rice | Modern | Roots & Seeds | Microbacteriaceae | *Curtobacterium* sp. |
| SYM01179 | 3 | 949 | Rice | Modern | Roots & Seeds | Microbacteriaceae | *Curtobacterium* sp. |
| SYM01181 | 3 | 951 | Rice | Modern | Roots & Seeds | Microbacteriaceae | *Curtobacterium* sp. |
| SYM01182 | 3 | 952 | Rice | Modern | Roots & Seeds | Microbacteriaceae | *Curtobacterium* sp. |
| SYM01183 | 3 | 953 | Rice | Modern | Roots & Seeds | Microbacteriaceae | *Curtobacterium* sp. |
| SYM01184 | 3 | 954 | Rice | Modern | Roots & Seeds | Microbacteriaceae | *Curtobacterium* sp. |
| SYM01185 | 3 | 955 | Rice | Modern | Roots & Seeds | Microbacteriaceae | *Curtobacterium* sp. |
| SYM01188 | 3 | 957 | Rice | Modern | Roots & Seeds | Microbacteriaceae | *Curtobacterium* sp. |
| SYM01198 | 3 | 962 | Rice | Modern | Roots & Seeds | Microbacteriaceae | *Curtobacterium* sp. |
| SYM01199 | 3 | 963 | Rice | Modern | Roots & Seeds | Microbacteriaceae | *Curtobacterium* sp. |
| SYM01201 | 3 | 964 | Rice | Modern | Roots & Seeds | Microbacteriaceae | *Curtobacterium* sp. |
| SYM01202 | 3 | 965 | Rice | Modern | Roots & Seeds | Microbacteriaceae | *Curtobacterium* sp. |
| SYM01204 | 3 | 966 | Rice | Modern | Roots & Seeds | Microbacteriaceae | *Curtobacterium* sp. |
| SYM01205 | 3 | 967 | Rice | Modern | Roots & Seeds | Microbacteriaceae | *Curtobacterium* sp. |
| SYM01207 | 3 | 969 | Rice | Modern | Roots & Seeds | Microbacteriaceae | *Curtobacterium* sp. |
| SYM01215 | 3 | 971 | Rice | Modern | Roots & Seeds | Microbacteriaceae | *Curtobacterium* sp. |
| SYM01218 | 3 | 973 | Rice | Modern | Roots & Seeds | Microbacteriaceae | *Curtobacterium* sp. |
| SYM01222 | 3 | 974 | Rice | Modern | Roots & Seeds | Microbacteriaceae | *Curtobacterium* sp. |
| SYM00188 | 6 | 605 | Maize | Modern | Leaves | Paenibacillaceae | *Paenibacillus* sp. |
| SYM00190 | 6 | 607 | Maize | Modern | Leaves | Paenibacillaceae | *Paenibacillus* sp. |
| SYM00195 | 6 | 610 | Maize | Modern | Leaves | Paenibacillaceae | *Paenibacillus* sp. |
| SYM00217 | 6 | 616 | Soybean | Modern | Roots | Paenibacillaceae | *Paenibacillus* sp. |
| SYM00227 | 6 | 619 | Soybean | Modern | Leaves | Paenibacillaceae | *Paenibacillus* sp. |
| SYM00292 | 6 | 634 | Maize | Modern | Surface sterilized seeds | Paenibacillaceae | *Paenibacillus taichungensis* |
| SYM00597 | 6 | 711 | Maize | Ancient Landrace | Seed surface wash | Paenibacillaceae | *Paenibacillus* sp. |
| SYM01108 | 6 | 915 | *Oryza nivara* | Wild relative | Surface sterilized seeds | Paenibacillaceae | *Paenibacillus* sp. |
| SYM01109 | 6 | 916 | *Oryza nivara* | Wild relative | Surface sterilized seeds | Paenibacillaceae | *Paenibacillus* sp. |
| SYM01110 | 6 | 917 | *Oryza nivara* | Wild relative | Surface sterilized seeds | Paenibacillaceae | *Paenibacillus* sp. |
| SYM01111 | 6 | 918 | *Oryza nivara* | Wild relative | Surface sterilized seeds | Paenibacillaceae | *Paenibacillus* sp. |
| SYM01112 | 6 | 919 | *Oryza nivara* | Wild relative | Surface sterilized seeds | Paenibacillaceae | *Paenibacillus* sp. |
| SYM01114 | 6 | 921 | Maize | Modern | Roots | Paenibacillaceae | *Paenibacillus* sp. |
| SYM01117 | 6 | 922 | Maize | Ancient Landrace | Roots | Paenibacillaceae | *Paenibacillus* sp. |
| SYM01118 | 6 | 923 | Maize | Ancient Landrace | Roots | Paenibacillaceae | *Paenibacillus* sp. |
| SYM01127 | 6 | 925 | Teosinte | Wild relative | Roots | Paenibacillaceae | *Paenibacillus* sp. |
| SYM01256 | 6 | 991 | Maize | Ancient Landrace | Roots | Paenibacillaceae | *Paenibacillus* sp. |
| SYM00014b | 7 | 527 | Teosinte | Wild relative | Surface sterilized seeds | Enterobacteriaceae | *Erwinia* sp. |
| SYM00017b | 7 | 532 | Rice | Modern | Surface sterilized seeds | Enterobacteriaceae | *Pantoea* sp. |
| SYM00018 | 7 | 534 | Maize | Ancient Landrace | Surface sterilized seeds | Enterobacteriaceae | *Pantoea* sp. |
| SYM00020 | 7 | 535 | Maize | Ancient Landrace | Surface sterilized seeds | Enterobacteriaceae | *Pantoea* sp. |
| SYM00022 | 7 | 537 | Teosinte | Wild relative | Surface sterilized seeds | Enterobacteriaceae | *Pantoea* sp. |
| SYM00025 | 7 | 538 | Maize | Ancient Landrace | Surface sterilized seeds | Enterobacteriaceae | *Pantoea* sp. |
| SYM00026 | 7 | 539 | Maize | Ancient Landrace | Surface sterilized seeds | Enterobacteriaceae | *Pantoea* sp. |
| SYM00043 | 7 | 544 | Maize | Modern | Surface sterilized seeds | Enterobacteriaceae | *Pantoea* sp. |
| SYM00047 | 7 | 546 | Maize | Ancient Landrace | Surface sterilized seeds | Enterobacteriaceae | *Pantoea* sp. |
| SYM00049 | 7 | 547 | Maize | Ancient Landrace | Surface sterilized seeds | Enterobacteriaceae | *Pantoea* sp. |
| SYM00055 | 7 | 553 | Maize | Ancient Landrace | Surface sterilized seeds | Enterobacteriaceae | *Pantoea* sp. |
| SYM00057 | 7 | 554 | Maize | Ancient Landrace | Surface sterilized seeds | Enterobacteriaceae | *Pantoea* sp. |
| SYM00058 | 7 | 555 | Maize | Ancient Landrace | Surface sterilized seeds | Enterobacteriaceae | *Pantoea* sp. |
| SYM00078 | 7 | 568 | Maize | Ancient Landrace | Surface sterilized seeds | Enterobacteriaceae | *Pantoea* sp. |
| SYM00081 | 7 | 569 | Maize | Ancient Landrace | Seed surface wash | Enterobacteriaceae | *Pantoea* sp. |
| SYM00082a | 7 | 570 | Maize | Ancient Landrace | Seed surface wash | Enterobacteriaceae | *Pantoea* sp. |
| SYM00085 | 7 | 571 | Maize | Modern | Surface sterilized seeds | Enterobacteriaceae | *Pantoea* sp. |
| SYM00086 | 7 | 572 | Maize | Modern | Surface sterilized seeds | Enterobacteriaceae | *Pantoea* sp. |
| SYM00087 | 7 | 573 | Maize | Maize PI 485356 | Surface sterilized seeds | Enterobacteriaceae | *Pantoea* sp. |
| SYM00088 | 7 | 574 | Maize | Maize PI 485356 | Surface sterilized seeds | Enterobacteriaceae | *Pantoea* sp. |
| SYM00094 | 7 | 576 | Maize | Ancient Landrace | Surface sterilized seeds | Enterobacteriaceae | *Pantoea* sp. |
| SYM00095 | 7 | 577 | Maize | Ancient Landrace | Surface sterilized seeds | Enterobacteriaceae | *Pantoea* sp. |
| SYM00096 | 7 | 578 | Maize | Ancient Landrace | Surface sterilized seeds | Enterobacteriaceae | *Pantoea* sp. |
| SYM00100 | 7 | 579 | Maize | Ancient Landrace | Surface sterilized seeds | Enterobacteriaceae | *Pantoea* sp. |
| SYM00101 | 7 | 580 | Maize | Ancient Landrace | Surface sterilized seeds | Enterobacteriaceae | *Pantoea* sp. |
| SYM00502 | 7 | 639 | Maize | Ancient Landrace | Seed surface wash | Enterobacteriaceae | *Erwinia* sp. |
| SYM00506 | 7 | 641 | Maize | Ancient Landrace | Seed surface wash | Enterobacteriaceae | *Erwinia* sp. |
| SYM00506b | 7 | 642 | Maize | Ancient Landrace | Seed surface wash | Enterobacteriaceae | *Erwinia* sp. |
| SYM00511 | 7 | 647 | Maize | Ancient Landrace | Seed surface wash | Enterobacteriaceae | *Erwinia* sp. |
| SYM00514b | 7 | 649 | Maize | Ancient Landrace | Seed surface wash | Enterobacteriaceae | *Erwinia* sp. |
| SYM00514C | 7 | 650 | Maize | Ancient Landrace | Seed surface wash | Enterobacteriaceae | *Erwinia* sp. |
| SYM00514D | 7 | 651 | Maize | Ancient Landrace | Seed surface wash | Enterobacteriaceae | *Erwinia* sp. |
| SYM00731A | 7 | 755 | Rice | Ancient Landrace | Seed surface wash | Enterobacteriaceae | *Erwinia* sp. |
| SYM00785 | 7 | 774 | Maize | Modern | Seed surface wash | Enterobacteriaceae | *Erwinia* sp. |
| SYM01056 | 7 | 903 | Teosinte | Wild relative | Surface sterilized seeds | Enterobacteriaceae | *Erwinia* sp. |
| SYM01235 | 7 | 984 | *Oryza officinalis* | Wild relative | Roots & Seeds | Enterobacteriaceae | *Erwinia* sp. |

TABLE 2-continued

Endophytic bacteria isolated from corn, rice and wheat seeds, including assignment to specific OTUs, corresponding Sequence ID numbers, Family, Genus, Taxonomic information and plant source from which the microbe was derived.

| SYM # | OTU# | SEQ ID NO: | Seed Crop Type | Seed Cultivar Type | Source of seed microbes | Family of Seed Microbe | Taxonomy of Seed Microbe |
|---|---|---|---|---|---|---|---|
| SYM01238 | 7 | 986 | *Oryza officinalis* | Wild relative | Roots & Seeds | Enterobacteriaceae | *Erwinia* sp. |
| SYM00967 | 8 | 837 | Rice | Ancient Landrace | Surface sterilized seeds | Methylobacteriaceae | |
| SYM01233 | 8 | 982 | *Oryza officinalis* | Wild relative | Roots & Seeds | Methylobacteriaceae | |
| SYM00544 | 9 | 663 | Maize | Ancient Landrace | Seed surface wash | Brucellaceae | *Ochrobactrum* sp. |
| SYM00545B | 9 | 665 | Maize | Ancient Landrace | Seed surface wash | Brucellaceae | *Ochrobactrum* sp. |
| SYM00548 | 9 | 667 | Maize | Ancient Landrace | Seed surface wash | Brucellaceae | *Ochrobactrum* sp. |
| SYM00552 | 9 | 670 | Maize | Ancient Landrace | Seed surface wash | Brucellaceae | *Ochrobactrum* sp. |
| SYM00558 | 9 | 675 | Maize | Ancient Landrace | Seed surface wash | Brucellaceae | *Ochrobactrum* sp. |
| SYM00580A | 9 | 688 | Maize | Modern | Seed surface wash | Brucellaceae | *Ochrobactrum* sp. |
| SYM00580b | 9 | 689 | Maize | Modern | Seed surface wash | Brucellaceae | *Ochrobactrum* sp. |
| SYM00580d | 9 | 691 | Maize | Modern | Seed surface wash | Brucellaceae | *Ochrobactrum* sp. |
| SYM00581d | 9 | 698 | Maize | Modern | Seed surface wash | Brucellaceae | *Ochrobactrum* sp. |
| SYM00583 | 9 | 699 | Maize | Ancient Landrace | Seed surface wash | Brucellaceae | *Ochrobactrum* sp. |
| SYM00584 | 9 | 700 | Maize | Ancient Landrace | Seed surface wash | Brucellaceae | *Ochrobactrum* sp. |
| SYM00588 | 9 | 705 | Maize | Ancient Landrace | Seed surface wash | Brucellaceae | *Ochrobactrum* sp. |
| SYM00596 | 9 | 710 | Maize | Ancient Landrace | Seed surface wash | Brucellaceae | *Ochrobactrum* sp. |
| SYM00600 | 9 | 713 | Maize | Ancient Landrace | Seed surface wash | Brucellaceae | *Ochrobactrum* sp. |
| SYM00746 | 9 | 757 | Rice | Ancient Landrace | Surface sterilized seeds | Brucellaceae | *Ochrobactrum* sp. |
| SYM00752 | 9 | 759 | Maize | Modern | Seed surface wash | Brucellaceae | *Ochrobactrum* sp. |
| SYM00756 | 9 | 761 | Maize | Modern | Seed surface wash | Brucellaceae | *Ochrobactrum* sp. |
| SYM00763 | 9 | 767 | Maize | Modern | Seed surface wash | Brucellaceae | *Ochrobactrum* sp. |
| SYM00783 | 9 | 772 | Maize | Modern | Seed surface wash | Brucellaceae | *Ochrobactrum* sp. |
| SYM00812 | 9 | 775 | Rice | Modern | Seed surface wash | Brucellaceae | *Ochrobactrum* sp. |
| SYM00902 | 9 | 783 | Maize | Ancient Landrace | Surface sterilized seeds | Brucellaceae | *Ochrobactrum* sp. |
| SYM00923 | 9 | 802 | Maize | Modern | Surface sterilized seeds | Brucellaceae | *Ochrobactrum* sp. |
| SYM00935 | 9 | 810 | Rice | Modern | Surface sterilized seeds | Brucellaceae | *Ochrobactrum* sp. |
| SYM00937 | 9 | 812 | Rice | Modern | Surface sterilized seeds | Brucellaceae | *Ochrobactrum* sp. |
| SYM00954 | 9 | 827 | Rice | Ancient Landrace | Surface sterilized seeds | Brucellaceae | *Ochrobactrum* sp. |
| SYM01029 | 9 | 883 | *Avena sterilis* | Wild relative | Surface sterilized seeds | Brucellaceae | *Ochrobactrum* sp. |
| SYM01043 | 9 | 894 | Rice | Modern | Surface sterilized seeds | Brucellaceae | *Ochrobactrum* sp. |
| SYM01047 | 9 | 896 | *Oryza latifolia* | Wild relative | Surface sterilized seeds | Brucellaceae | *Ochrobactrum* sp. |
| SYM01052 | 9 | 899 | Maize | Ancient Landrace | Surface sterilized seeds | Brucellaceae | *Ochrobactrum* sp. |
| SYM01054 | 9 | 901 | Maize | Ancient Landrace | Surface sterilized seeds | Brucellaceae | *Ochrobactrum* sp. |
| SYM01055 | 9 | 902 | Maize | Ancient Landrace | Surface sterilized seeds | Brucellaceae | *Ochrobactrum* sp. |
| SYM01058 | 9 | 904 | Maize | Ancient Landrace | Surface sterilized seeds | Brucellaceae | *Ochrobactrum* sp. |
| SYM01064 | 9 | 906 | Maize | Ancient Landrace | Surface sterilized seeds | Brucellaceae | *Ochrobactrum* sp. |
| SYM01066 | 9 | 908 | Maize | Ancient Landrace | Surface sterilized seeds | Brucellaceae | *Ochrobactrum* sp. |
| SYM01069 | 9 | 909 | Maize | Modern | Surface sterilized seeds | Brucellaceae | *Ochrobactrum* sp. |
| SYM01079 | 9 | 913 | Maize | Modern | Surface sterilized seeds | Brucellaceae | *Ochrobactrum* sp. |
| SYM00064a | 10 | 560 | Teosinte | Wild relative | Surface sterilized seeds | Xanthomonadaceae | *Stenotrophomonas* sp. |
| SYM00183 | 10 | 603 | *Oryza glumipatula* | Wild relative | Surface sterilized seeds | Xanthomonadaceae | *Stenotrophomonas* sp. |
| SYM00184 | 10 | 604 | *Oryza glumipatula* | Wild relative | Surface sterilized seeds | Xanthomonadaceae | *Stenotrophomonas* sp. |
| SYM00905 | 10 | 786 | Maize | Modern | Surface sterilized seeds | Xanthomonadaceae | *Stenotrophomonas* sp. |
| SYM00543 | 12 | 662 | Maize | Ancient Landrace | Seed surface wash | Bacillaceae | *Bacillus* sp. |
| SYM00595 | 12 | 709 | Maize | Ancient Landrace | Seed surface wash | Bacillaceae | *Bacillus* sp. |
| SYM01227 | 12 | 977 | Rice | Modern | Roots & Seeds | Bacillaceae | *Bacillus* sp. |
| SYM00547 | 13 | 666 | Maize | Ancient Landrace | Seed surface wash | Alcaligenaceae | *Achromobacter* sp. |
| SYM00551 | 13 | 669 | Maize | Ancient Landrace | Seed surface wash | Alcaligenaceae | *Achromobacter* sp. |
| SYM00560 | 13 | 676 | Maize | Ancient Landrace | Seed surface wash | Alcaligenaceae | *Achromobacter* sp. |
| SYM00565B | 13 | 681 | Maize | Modern | Seed surface wash | Alcaligenaceae | *Achromobacter* sp. |
| SYM00580C | 13 | 690 | Maize | Modern | Seed surface wash | Alcaligenaceae | *Achromobacter* sp. |
| SYM00580i | 13 | 694 | Maize | Modern | Seed surface wash | Alcaligenaceae | *Achromobacter* sp. |
| SYM00585 | 13 | 701 | Maize | Ancient Landrace | seed surface wash | Alcaligenaceae | *Achromobacter* sp. |
| SYM00586b | 13 | 702 | Maize | Ancient Landrace | Seed surface wash | Alcaligenaceae | *Achromobacter* sp. |
| SYM00588b | 13 | 706 | Maize | Ancient Landrace | Seed surface wash | Alcaligenaceae | *Achromobacter* sp. |
| SYM00591 | 13 | 708 | Maize | Ancient Landrace | Seed surface wash | Alcaligenaceae | *Achromobacter* sp. |
| SYM00602 | 13 | 715 | Maize | Modern | Seed surface wash | Alcaligenaceae | *Achromobacter* sp. |
| SYM00758 | 13 | 763 | Maize | Modern | Seed surface wash | Alcaligenaceae | *Achromobacter* sp. |
| SYM00761 | 13 | 765 | Maize | Modern | Seed surface wash | Alcaligenaceae | *Achromobacter* sp. |
| SYM00764 | 13 | 768 | Maize | Modern | Seed surface wash | Alcaligenaceae | *Achromobacter* sp. |
| SYM00765 | 13 | 769 | Maize | Modern | Seed surface wash | Alcaligenaceae | *Achromobacter* sp. |
| SYM00824 | 13 | 777 | Rice | Ancient Landrace | Seed surface wash | Alcaligenaceae | *Achromobacter* sp. |
| SYM00828 | 13 | 778 | Rice | Ancient Landrace | Seed surface wash | Alcaligenaceae | *Achromobacter* sp. |
| SYM00830 | 13 | 779 | Rice | Ancient Landrace | Seed surface wash | Alcaligenaceae | *Achromobacter* sp. |
| SYM00831 | 13 | 780 | Rice | Ancient Landrace | Seed surface wash | Alcaligenaceae | *Achromobacter* sp. |
| SYM00901 | 13 | 782 | Maize | Ancient Landrace | Surface sterilized seeds | Alcaligenaceae | *Achromobacter* sp. |
| SYM00903 | 13 | 784 | Maize | Modern | Surface sterilized seeds | Alcaligenaceae | *Achromobacter* sp. |
| SYM00904 | 13 | 785 | Maize | Modern | Surface sterilized seeds | Alcaligenaceae | *Achromobacter* sp. |
| SYM00907 | 13 | 787 | Maize | Modern | Surface sterilized seeds | Alcaligenaceae | *Achromobacter* sp. |
| SYM00908 | 13 | 788 | Maize | Ancient Landrace | Surface sterilized seeds | Alcaligenaceae | *Achromobacter* sp. |
| SYM00909 | 13 | 789 | Maize | Ancient Landrace | Surface sterilized seeds | Alcaligenaceae | *Achromobacter* sp. |
| SYM00910 | 13 | 790 | Maize | Modern | Surface sterilized seeds | Alcaligenaceae | *Achromobacter* sp. |
| SYM00914 | 13 | 794 | Maize | Modern | Surface sterilized seeds | Alcaligenaceae | *Achromobacter* sp. |
| SYM00917 | 13 | 796 | Maize | Modern | Surface sterilized seeds | Alcaligenaceae | *Achromobacter* sp. |

TABLE 2-continued

Endophytic bacteria isolated from corn, rice and wheat seeds, including assignment to specific OTUs, corresponding Sequence ID numbers, Family, Genus, Taxonomic information and plant source from which the microbe was derived.

| SYM # | OTU# | SEQ ID NO: | Seed Crop Type | Seed Cultivar Type | Source of seed microbes | Family of Seed Microbe | Taxonomy of Seed Microbe |
|---|---|---|---|---|---|---|---|
| SYM00929 | 13 | 806 | *Oryza latifolia* | Wild relative | Surface sterilized seeds | Alcaligenaceae | *Achromobacter* sp. |
| SYM00930 | 13 | 807 | Rice | Modern | Surface sterilized seeds | Alcaligenaceae | *Achromobacter* sp. |
| SYM00938 | 13 | 813 | Rice | Modern | Surface sterilized seeds | Alcaligenaceae | *Achromobacter* sp. |
| SYM00957 | 13 | 829 | Rice | Ancient Landrace | Surface sterilized seeds | Alcaligenaceae | *Achromobacter* sp. |
| SYM00959 | 13 | 830 | Rice | Ancient Landrace | Surface sterilized seeds | Alcaligenaceae | *Achromobacter* sp. |
| SYM01017 | 13 | 875 | Rice | Modern | Surface sterilized seeds | Alcaligenaceae | *Achromobacter* sp. |
| SYM01020 | 13 | 877 | Rice | Modern | Surface sterilized seeds | Alcaligenaceae | *Achromobacter* sp. |
| SYM01021 | 13 | 878 | *Oryza nivara* | Wild relative | Surface sterilized seeds | Alcaligenaceae | *Achromobacter* sp. |
| SYM01030 | 13 | 884 | *Avena sterilis* | Wild relative | Surface sterilized seeds | Alcaligenaceae | *Achromobacter* sp. |
| SYM00028 | 18 | 540 | Maize | Ancient Landrace | Surface sterilized seeds | Enterobacteriaceae | *Enterobacter* sp. |
| SYM00052 | 18 | 550 | Teosinte | Wild relative | Surface sterilized seeds | Enterobacteriaceae | *Enterobacter* sp. |
| SYM00053 | 18 | 551 | Teosinte | Wild relative | Surface sterilized seeds | Enterobacteriaceae | *Enterobacter* sp. |
| SYM00054 | 18 | 552 | Teosinte | Wild relative | Surface sterilized seeds | Enterobacteriaceae | *Enterobacter* sp. |
| SYM00175 | 18 | 595 | Winter rye | Modern | Surface sterilized seeds | Enterobacteriaceae | *Enterobacter* sp. |
| SYM00627 | 18 | 725 | Maize | Modern | Seed surface wash | Enterobacteriaceae | *Enterobacter* sp. |
| SYM00715 | 18 | 751 | Rice | Modern | Seed surface wash | Enterobacteriaceae | *Enterobacter* sp. |
| SYM00189 | 19 | 606 | Maize | Modern | Leaves | Bacillaceae | *Bacillus* sp. |
| SYM00192 | 19 | 608 | Maize | Modern | Leaves | Bacillaceae | *Bacillus* sp. |
| SYM00197 | 19 | 611 | Maize | Modern | Leaves | Bacillaceae | *Bacillus* sp. |
| SYM00201 | 19 | 612 | Maize | Maize | Roots | Bacillaceae | *Bacillus* sp. |
| SYM00202 | 19 | 613 | Maize | Maize | Roots | Bacillaceae | *Bacillus* sp. |
| SYM00215 | 19 | 615 | Soybean | Modern | Roots | Bacillaceae | *Bacillus* sp. |
| SYM00233 | 19 | 621 | Soybean | Modern | Leaves | Bacillaceae | *Bacillus* sp. |
| SYM00260 | 19 | 632 | Maize | Modern | Surface sterilized seeds | Bacillaceae | *Bacillus simplex* |
| SYM01113 | 19 | 920 | Maize | Modern | Roots | Bacillaceae | *Bacillus* sp. |
| SYM01119 | 19 | 924 | Maize | Ancient Landrace | Roots | Bacillaceae | *Bacillus* sp. |
| SYM00016b | 25 | 529 | Rice | Modern | Surface sterilized seeds | Methylobacteriaceae | *Methylobacterium* sp. |
| SYM00236 | 25 | 623 | Rice | Modern | Surface sterilized seeds | Methylobacteriaceae | *Methylobacterium* sp. |
| SYM00237 | 25 | 624 | Rice | Modern | Surface sterilized seeds | Methylobacteriaceae | *Methylobacterium* sp. |
| SYM00240 | 25 | 625 | Rice | Modern | Surface sterilized seeds | Methylobacteriaceae | *Methylobacterium* sp. |
| SYM00924 | 25 | 803 | Rice | Ancient Landrace | Surface sterilized seeds | Methylobacteriaceae | *Methylobacterium* sp. |
| SYM00936 | 25 | 811 | Rice | Modern | Surface sterilized seeds | Methylobacteriaceae | *Methylobacterium* sp. |
| SYM00950 | 25 | 824 | Rice | Ancient Landrace | Surface sterilized seeds | Methylobacteriaceae | *Methylobacterium* sp. |
| SYM00968 | 25 | 838 | Rice | Ancient Landrace | Surface sterilized seeds | Methylobacteriaceae | *Methylobacterium* sp. |
| SYM00986 | 25 | 852 | Rice | Modern | Surface sterilized seeds | Methylobacteriaceae | *Methylobacterium* sp. |
| SYM00998 | 25 | 861 | *Oryza officinalis* | Wild relative | Surface sterilized seeds | Methylobacteriaceae | *Methylobacterium* sp. |
| SYM00999 | 25 | 862 | *Oryza officinalis* | Wild relative | Surface sterilized seeds | Methylobacteriaceae | *Methylobacterium* sp. |
| SYM01003 | 25 | 864 | Rice | Modern | Surface sterilized seeds | Methylobacteriaceae | *Methylobacterium* sp. |
| SYM01008 | 25 | 868 | Rice | Modern | Surface sterilized seeds | Methylobacteriaceae | *Methylobacterium* sp. |
| SYM00501 | 27 | 638 | Maize | Ancient Landrace | Seed surface wash | Burkholderiaceae | *Burkholderia* sp. |
| SYM00504 | 27 | 640 | Maize | Ancient Landrace | Seed surface wash | Burkholderiaceae | *Burkholderia* sp. |
| SYM00536 | 27 | 656 | Maize | Ancient Landrace | Seed surface wash | Burkholderiaceae | *Burkholderia* sp. |
| SYM00536A | 27 | 657 | Maize | Ancient Landrace | Seed surface wash | Burkholderiaceae | *Burkholderia* sp. |
| SYM00538E | 27 | 659 | Maize | Ancient Landrace | Seed surface wash | Burkholderiaceae | *Burkholderia* sp. |
| SYM00566A | 27 | 682 | Maize | Modern | Seed surface wash | Burkholderiaceae | *Burkholderia* sp. |
| SYM00568 | 27 | 683 | Maize | Modern | Seed surface wash | Burkholderiaceae | *Burkholderia* sp. |
| SYM00570 | 27 | 684 | Maize | Modern | Seed surface wash | Burkholderiaceae | *Burkholderia* sp. |
| SYM00574 | 27 | 685 | Maize | Ancient Landrace | Seed surface wash | Burkholderiaceae | *Burkholderia* sp. |
| SYM00575 | 27 | 686 | Maize | Ancient Landrace | Seed surface wash | Burkholderiaceae | *Burkholderia* sp. |
| SYM00578 | 27 | 687 | Maize | Modern | Seed surface wash | Burkholderiaceae | *Burkholderia* sp. |
| SYM00621 | 27 | 721 | Maize | Modern | Seed surface wash | Burkholderiaceae | *Burkholderia* sp. |
| SYM00623 | 27 | 722 | Maize | Modern | Seed surface wash | Burkholderiaceae | *Burkholderia* sp. |
| SYM00624 | 27 | 723 | Maize | Modern | Seed surface wash | Burkholderiaceae | *Burkholderia* sp. |
| SYM00633 | 27 | 727 | Maize | Ancient Landrace | Seed surface wash | Burkholderiaceae | *Burkholderia* sp. |
| SYM00822 | 27 | 776 | Rice | Modern | Seed surface wash | Burkholderiaceae | *Burkholderia* sp. |
| SYM01010 | 27 | 869 | Rice | Ancient Landrace | Surface sterilized seeds | Burkholderiaceae | *Burkholderia* sp. |
| SYM01012 | 27 | 871 | Rice | Ancient Landrace | Surface sterilized seeds | Burkholderiaceae | *Burkholderia* sp. |
| SYM01015 | 27 | 873 | Rice | Ancient Landrace | Surface sterilized seeds | Burkholderiaceae | *Burkholderia* sp. |
| SYM01037 | 27 | 889 | Rice | Modern | Surface sterilized seeds | Burkholderiaceae | *Burkholderia* sp. |
| SYM00037 | 28 | 543 | Maize | Modern | Surface sterilized seeds | Microbacteriaceae | *Bacillus* sp. |
| SYM00051 | 28 | 549 | Teosinte | Wild relative | Surface sterilized seeds | Microbacteriaceae | *Microbacterium* sp. |
| SYM00104 | 28 | 582 | Maize | Ancient Landrace | Surface sterilized seeds | Microbacteriaceae | *Microbacterium* sp. |
| SYM00177 | 28 | 597 | *Oryza nivara* | Wild relative | Surface sterilized seeds | Microbacteriaceae | *Microbacterium* sp. |
| SYM00514A | 28 | 648 | Maize | Ancient Landrace | Seed surface wash | Microbacteriaceae | *Microbacterium* sp. |
| SYM00523 | 28 | 652 | *Oryza nivara* | Wild relative | Seed surface wash | Microbacteriaceae | *Microbacterium* sp. |
| SYM00538H | 28 | 660 | Maize | Ancient Landrace | Seed surface wash | Microbacteriaceae | *Microbacterium* sp. |
| SYM00542 | 28 | 661 | Maize | Ancient Landrace | Seed surface wash | Microbacteriaceae | *Microbacterium* sp. |
| SYM00556 | 28 | 674 | Maize | Ancient Landrace | Seed surface wash | Microbacteriaceae | *Microbacterium* sp. |
| SYM00581A | 28 | 695 | Maize | Modern | Seed surface wash | Microbacteriaceae | *Microbacterium* sp. |
| SYM00586c | 28 | 703 | Maize | Ancient Landrace | Seed surface wash | Microbacteriaceae | *Microbacterium* sp. |
| SYM00587 | 28 | 704 | Maize | Ancient Landrace | Seed surface wash | Microbacteriaceae | *Microbacterium* sp. |
| SYM00598 | 28 | 712 | Maize | Ancient Landrace | Seed surface wash | Microbacteriaceae | *Microbacterium* sp. |
| SYM00757 | 28 | 762 | Maize | Modern | Seed surface wash | Microbacteriaceae | *Microbacterium* sp. |
| SYM00760 | 28 | 764 | Maize | Modern | Seed surface wash | Microbacteriaceae | *Microbacterium* sp. |

TABLE 2-continued

Endophytic bacteria isolated from corn, rice and wheat seeds, including assignment to specific OTUs, corresponding Sequence ID numbers, Family, Genus, Taxonomic information and plant source from which the microbe was derived.

| SYM # | OTU# | SEQ ID NO: | Seed Crop Type | Seed Cultivar Type | Source of seed microbes | Family of Seed Microbe | Taxonomy of Seed Microbe |
|---|---|---|---|---|---|---|---|
| SYM00780 | 28 | 771 | Maize | Modern | Seed surface wash | Microbacteriaceae | *Microbacterium* sp. |
| SYM00832 | 28 | 781 | Rice | Ancient Landrace | Seed surface wash | Microbacteriaceae | *Microbacterium* sp. |
| SYM00911 | 28 | 791 | Maize | Modern | Surface sterilized seeds | Microbacteriaceae | *Microbacterium* sp. |
| SYM00912 | 28 | 792 | Maize | Ancient Landrace | Surface sterilized seeds | Microbacteriaceae | *Microbacterium* sp. |
| SYM00913 | 28 | 793 | Maize | Ancient Landrace | Surface sterilized seeds | Microbacteriaceae | *Microbacterium* sp. |
| SYM00915 | 28 | 795 | Maize | Modern | Surface sterilized seeds | Microbacteriaceae | *Microbacterium* sp. |
| SYM00918 | 28 | 797 | Maize | Ancient Landrace | Surface sterilized seeds | Microbacteriaceae | *Microbacterium* sp. |
| SYM00919 | 28 | 798 | Maize | Ancient Landrace | Surface sterilized seeds | Microbacteriaceae | *Microbacterium* sp. |
| SYM00920 | 28 | 799 | Maize | Ancient Landrace | Surface sterilized seeds | Microbacteriaceae | *Microbacterium* sp. |
| SYM00921 | 28 | 800 | Maize | Modern | Surface sterilized seeds | Microbacteriaceae | *Microbacterium* sp. |
| SYM00922 | 28 | 801 | Maize | Modern | Surface sterilized seeds | Microbacteriaceae | *Microbacterium* sp. |
| SYM00931 | 28 | 808 | Rice | Modern | Surface sterilized seeds | Microbacteriaceae | *Microbacterium* sp. |
| SYM00933 | 28 | 809 | Rice | Modern | Surface sterilized seeds | Microbacteriaceae | *Microbacterium* sp. |
| SYM00939 | 28 | 814 | Rice | Modern | Surface sterilized seeds | Microbacteriaceae | *Microbacterium* sp. |
| SYM00944 | 28 | 819 | Rice | Modern | Surface sterilized seeds | Microbacteriaceae | *Microbacterium* sp. |
| SYM00962 | 28 | 832 | Rice | Ancient Landrace | Surface sterilized seeds | Microbacteriaceae | *Microbacterium* sp. |
| SYM01000 | 28 | 863 | *Oryza officinalis* | Wild relative | Surface sterilized seeds | Microbacteriaceae | *Microbacterium* sp. |
| SYM01034 | 28 | 886 | *Avena sterilis* | Wild relative | Surface sterilized seeds | Microbacteriaceae | *Microbacterium* sp. |
| SYM01206 | 28 | 968 | Rice | Modern | Roots & Seeds | Microbacteriaceae | *Microbacterium* sp. |
| SYM00015 | 29 | 528 | Rice | Modern | Surface sterilized seeds | Xanthomonadaceae | *Xanthomonas* sp. |
| SYM00021 | 29 | 536 | Teosinte | Wild relative | Surface sterilized seeds | Xanthomonadaceae | *Xanthomonas* sp. |
| SYM00179 | 29 | 599 | Rice | Ancient Landrace | Surface sterilized seeds | Xanthomonadaceae | *Xanthomonas* sp. |
| SYM00182 | 29 | 602 | Rice | Ancient Landrace | Surface sterilized seeds | Xanthomonadaceae | *Xanthomonas* sp. |
| SYM00252 | 29 | 630 | Rice | Ancient Landrace | Surface sterilized seeds | Xanthomonadaceae | *Xanthomonas* sp. |
| SYM00977 | 29 | 845 | Rice | Ancient Landrace | Surface sterilized seeds | Xanthomonadaceae | *Xanthomonas* sp. |
| SYM00988 | 29 | 854 | Rice | Modern | Surface sterilized seeds | Xanthomonadaceae | *Xanthomonas* sp. |
| SYM00997 | 29 | 860 | *Oryza officinalis* | Wild relative | Surface sterilized seeds | Xanthomonadaceae | *Xanthomonas* sp. |
| SYM01018 | 29 | 876 | Rice | Modern | Surface sterilized seeds | Xanthomonadaceae | *Xanthomonas* sp. |
| SYM01028 | 29 | 882 | *Oryza nivara* | Wild relative | Surface sterilized seeds | Xanthomonadaceae | *Xanthomonas* sp. |
| SYM01146 | 29 | 930 | Rice | Modern | Roots & Seeds | Xanthomonadaceae | *Xanthomonas* sp. |
| SYM01153 | 29 | 933 | Rice | Modern | Roots & Seeds | Xanthomonadaceae | *Xanthomonas* sp. |
| SYM01154 | 29 | 934 | Rice | Modern | Roots & Seeds | Xanthomonadaceae | *Xanthomonas* sp. |
| SYM01162 | 29 | 939 | Rice | Ancient Landrace | Roots & Seeds | Xanthomonadaceae | *Xanthomonas* sp. |
| SYM01190 | 29 | 959 | Rice | Modern | Roots & Seeds | Xanthomonadaceae | *Xanthomonas* sp. |
| SYM00565A | 30 | 680 | Maize | Modern | Seed surface wash | Nocardiaceae | *Rhodococcus* sp. |
| SYM00580G | 30 | 693 | Maize | Modern | Seed surface wash | Nocardiaceae | *Rhodococcus* sp. |
| SYM00753 | 30 | 760 | Maize | Modern | Seed surface wash | Nocardiaceae | *Rhodococcus* sp. |
| SYM00762 | 30 | 766 | Maize | Modern | Seed surface wash | Nocardiaceae | *Rhodococcus* sp. |
| SYM00775 | 30 | 770 | Maize | Modern | Seed surface wash | Nocardiaceae | *Rhodococcus* sp. |
| SYM00943 | 30 | 818 | Rice | Modern | Surface sterilized seeds | Nocardiaceae | *Rhodococcus* sp. |
| SYM00951 | 30 | 825 | Rice | Ancient Landrace | Surface sterilized seeds | Nocardiaceae | *Rhodococcus* sp. |
| SYM01039 | 30 | 890 | Rice | Ancient Landrace | Surface sterilized seeds | Nocardiaceae | *Rhodococcus* sp. |
| SYM01040 | 30 | 891 | Rice | Ancient Landrace | Surface sterilized seeds | Nocardiaceae | *Rhodococcus* sp. |
| SYM01042 | 30 | 893 | Rice | Modern | Surface sterilized seeds | Nocardiaceae | *Rhodococcus* sp. |
| SYM01046 | 30 | 895 | Rice | Modern | Surface sterilized seeds | Nocardiaceae | *Rhodococcus* sp. |
| SYM01048 | 30 | 897 | *Oryza latifolia* | Wild relative | Surface sterilized seeds | Nocardiaceae | *Rhodococcus* sp. |
| SYM01053 | 30 | 900 | Maize | Modern | Surface sterilized seeds | Nocardiaceae | *Rhodococcus* sp. |
| SYM01063 | 30 | 905 | Maize | Modern | Surface sterilized seeds | Nocardiaceae | *Rhodococcus* sp. |
| SYM01065 | 30 | 907 | Maize | Ancient Landrace | Surface sterilized seeds | Nocardiaceae | *Rhodococcus* sp. |
| SYM01070 | 30 | 910 | Rice | Modern | Surface sterilized seeds | Nocardiaceae | *Rhodococcus* sp. |
| SYM01071 | 30 | 911 | Maize | Ancient Landrace | Surface sterilized seeds | Nocardiaceae | *Rhodococcus* sp. |
| SYM01078 | 30 | 912 | Rice | Modern | Surface sterilized seeds | Nocardiaceae | *Rhodococcus* sp. |
| SYM00589 | 31 | 707 | Maize | Ancient Landrace | Seed surface wash | Paenibacillaceae | *Paenibacillus* sp. |
| SYM00991 | 36 | 855 | Rice | Modern | Surface sterilized seeds | Comamonadaceae | *Acidovorax* sp. |
| SYM01236 | 36 | 985 | *Oryza officinalis* | Wild relative | Roots & Seeds | Comamonadaceae | *Acidovorax* sp. |
| SYM00057B | 37 | 1446 | Maize | Ancient Landrace | Surface sterilized seeds | Burkholderiaceae | *Burkholderia phytofirmans* |
| SYM00102 | 38 | 581 | Maize | Ancient Landrace | Surface sterilized seeds | Staphylococcaceae | *Staphylococcus* sp. |
| SYM00072 | 39 | 566 | Teosinte | Wild relative | Surface sterilized seeds | Bacillaceae | *Bacillus* sp. |
| SYM00075 | 39 | 567 | Teosinte | Wild relative | Surface sterilized seeds | Bacillaceae | *Bacillus* sp. |
| SYM00249 | 39 | 628 | Soybean | Modern | Surface sterilized seeds | Bacillaceae | *Bacillus* sp. |
| SYM00507 | 39 | 645 | Maize | Ancient Landrace | Seed surface wash | Bacillaceae | *Bacillus* sp. |
| SYM00553 | 39 | 671 | Maize | Ancient Landrace | Seed surface wash | Bacillaceae | *Bacillus* sp. |
| SYM00562 | 39 | 677 | Maize | Ancient Landrace | Seed surface wash | Bacillaceae | *Bacillus* sp. |
| SYM00564 | 39 | 679 | Maize | Ancient Landrace | Seed surface wash | Bacillaceae | *Bacillus* sp. |
| SYM00580E | 39 | 692 | Maize | Modern | Seed surface wash | Bacillaceae | *Bacillus* sp. |
| SYM00581b | 39 | 696 | Maize | Modern | Seed surface wash | Bacillaceae | *Bacillus* sp. |
| SYM00581c | 39 | 697 | Maize | Modern | Seed surface wash | Bacillaceae | *Bacillus* sp. |
| SYM00601 | 39 | 714 | Maize | Ancient Landrace | Seed surface wash | Bacillaceae | *Bacillus* sp. |
| SYM00036 | 41 | 542 | Maize | Modern | Surface sterilized seeds | Bacillaceae | *Bacillus* sp. |
| SYM00110 | 41 | 586 | Maize | Modern | Surface sterilized seeds | Bacillaceae | *Bacillus* sp. |
| SYM00193 | 41 | 609 | Maize | Modern | Leaves | Bacillaceae | *Bacillus* sp. |
| SYM00218 | 41 | 617 | Soybean | Modern | Roots | Bacillaceae | *Bacillus* sp. |
| SYM00250 | 41 | 629 | Soybean | Modern | Surface sterilized seeds | Bacillaceae | *Bacillus* sp. |
| SYM00697 | 41 | 745 | Rice | Modern | Seed surface wash | Bacillaceae | *Bacillus* sp. |

TABLE 2-continued

Endophytic bacteria isolated from corn, rice and wheat seeds, including assignment to specific OTUs, corresponding Sequence ID numbers, Family, Genus, Taxonomic information and plant source from which the microbe was derived.

| SYM # | OTU# | SEQ ID NO: | Seed Crop Type | Seed Cultivar Type | Source of seed microbes | Family of Seed Microbe | Taxonomy of Seed Microbe |
|---|---|---|---|---|---|---|---|
| SYM00704 | 41 | 746 | Rice | Modern | Seed surface wash | Bacillaceae | *Bacillus* sp. |
| SYM00017c | 45 | 533 | Rice | Modern | Surface sterilized seeds | Sphingomonadaceae | *Sphingomonas* sp. |
| SYM00062b | 45 | 558 | Teosinte | Wild relative | Surface sterilized seeds | Sphingomonadaceae | *Sphingomonas* sp. |
| SYM00065 | 45 | 561 | Teosinte | Wild relative | Surface sterilized seeds | Sphingomonadaceae | *Sphingomonas* sp. |
| SYM00168 | 45 | 589 | Rice | Modern | Surface sterilized seeds | Sphingomonadaceae | *Sphingomonas* sp. |
| SYM00169 | 45 | 590 | Rice | Modern | Surface sterilized seeds | Sphingomonadaceae | *Sphingomonas* sp. |
| SYM00942 | 45 | 817 | Rice | Modern | Surface sterilized seeds | Sphingomonadaceae | *Sphingomonas* sp. |
| SYM00994 | 45 | 858 | *Oryza officinalis* | Wild relative | Surface sterilized seeds | Sphingomonadaceae | *Sphingomonas* sp. |
| SYM01016 | 45 | 874 | Rice | Modern | Surface sterilized seeds | Sphingomonadaceae | *Sphingomonas* sp. |
| SYM01174 | 45 | 944 | Rice | Ancient Landrace | Roots & Seeds | Sphingomonadaceae | *Sphingomonas* sp. |
| SYM01176 | 45 | 946 | Rice | Ancient Landrace | Roots & Seeds | Sphingomonadaceae | *Sphingomonas* sp. |
| SYM01187 | 45 | 956 | Rice | Modern | Roots & Seeds | Sphingomonadaceae | *Sphingomonas* sp. |
| SYM01191 | 45 | 960 | Rice | Modern | Roots & Seeds | Sphingomonadaceae | *Sphingomonas* sp. |
| SYM01214 | 45 | 970 | Rice | Modern | Roots & Seeds | Sphingomonadaceae | *Sphingomonas* sp. |
| SYM01216 | 45 | 972 | Rice | Modern | Roots & Seeds | Sphingomonadaceae | *Sphingomonas* sp. |
| SYM00231 | 46 | 620 | Soybean | Modern | Leaves | Sphingomonadaceae | *Sphingobium* sp. |
| SYM00975 | 51 | 843 | Rice | Ancient Landrace | Surface sterilized seeds | Oxalobacteraceae | *Herbaspirillum* sp. |
| SYM00506c | 53 | 643 | Maize | Ancient Landrace | Seed surface wash | Paenibacillaceae | *Paenibacillus* sp. |
| SYM00506D | 53 | 644 | Maize | Ancient Landrace | Seed surface wash | Paenibacillaceae | *Paenibacillus* sp. |
| SYM00545 | 53 | 664 | Maize | Ancient Landrace | Seed surface wash | Paenibacillaceae | *Paenibacillus* sp. |
| SYM00549 | 53 | 668 | Maize | Ancient Landrace | Seed surface wash | Paenibacillaceae | *Paenibacillus* sp. |
| SYM00554 | 53 | 672 | Maize | Ancient Landrace | Seed surface wash | Paenibacillaceae | *Paenibacillus* sp. |
| SYM00555 | 53 | 673 | Maize | Ancient Landrace | Seed surface wash | Paenibacillaceae | *Paenibacillus* sp. |
| SYM00012 | 55 | 1447 | Teosinte | Wild relative | Surface sterilized seeds | Microbacteriaceae | *Microbacterium binotii* |
| SYM00046 | 56 | 545 | Maize | Ancient Landrace | Surface sterilized seeds | Enterobacteriaceae | *Enterobacter* sp. |
| SYM00050 | 56 | 548 | Maize | Ancient Landrace | Surface sterilized seeds | Enterobacteriaceae | *Enterobacter* sp. |
| SYM00628 | 56 | 726 | Maize | Modern | Seed surface wash | Enterobacteriaceae | *Enterobacter* sp. |
| SYM01049 | 56 | 898 | Teosinte | Wild relative | Surface sterilized seeds | Enterobacteriaceae | |
| SYM00106 | 59 | 583 | Maize | Ancient Landrace | Surface sterilized seeds | Micrococcaceae | *Micrococcus* sp. |
| SYM00107 | 59 | 584 | Maize | Ancient Landrace | Surface sterilized seeds | Micrococcaceae | *Micrococcus* sp. |
| SYM00108 | 59 | 585 | Maize | Ancient Landrace | Surface sterilized seeds | Micrococcaceae | *Micrococcus* sp. |
| SYM00254 | 59 | 631 | Maize | Modern | Surface sterilized seeds | Micrococcaceae | *Micrococcus* sp. |
| SYM00090 | 62 | 575 | Maize | Ancient Landrace | Surface sterilized seeds | Flavobacteriaceae | *Chryseobacterium* sp. |
| SYM00002 | 66 | 521 | Teosinte | Wild relative | Surface sterilized seeds | Rhizobiaceae | *Agrobacterium* sp. |
| SYM00017a | 66 | 531 | Rice | Modern | Surface sterilized seeds | Rhizobiaceae | *Agrobacterium* sp. |
| SYM00326 | 66 | 635 | Maize | Modern | Roots | Rhizobiaceae | *Agrobacterium tumefaciens* |
| SYM00714 | 66 | 750 | Rice | Modern | Seed surface wash | Rhizobiaceae | *Agrobacterium* sp. |
| SYM00983 | 66 | 849 | Rice | Modern | Surface sterilized seeds | Rhizobiaceae | *Agrobacterium* sp. |
| SYM01004 | 66 | 865 | Rice | Modern | Surface sterilized seeds | Rhizobiaceae | *Agrobacterium* sp. |
| SYM00060 | 67 | 556 | Maize | Ancient Landrace | Surface sterilized seeds | Staphylococcaceae | *Staphylococcus* sp. |
| SYM00113 | 67 | 587 | Maize | Modern | Surface sterilized seeds | Staphylococcaceae | *Staphylococcus* sp. |
| SYM01257 | 67 | 992 | Rice | Ancient Landrace | Roots & Seeds | Staphylococcaceae | *Staphylococcus* sp. |
| SYM01259 | 67 | 993 | Rice | Ancient Landrace | Roots & Seeds | Staphylococcaceae | *Staphylococcus* sp. |
| SYM00071 | 76 | 565 | Teosinte | Wild relative | Surface sterilized seeds | Bacillaceae | *Bacillus* sp. |
| SYM00204 | 76 | 614 | Maize | Maize | Roots | Bacillaceae | *Bacillus* sp. |
| SYM00563 | 76 | 678 | Maize | Ancient Landrace | Seed surface wash | Bacillaceae | *Bacillus* sp. |
| SYM00617 | 76 | 719 | Teosinte | Wild relative | Seed surface wash | Bacillaceae | *Bacillus* sp. |
| SYM00016c | 82 | 530 | Rice | Modern | Surface sterilized seeds | Xanthomonadaceae | *Luteibacter* sp. |
| SYM00960 | 82 | 831 | Rice | Ancient Landrace | Surface sterilized seeds | Xanthomonadaceae | *Luteibacter* sp. |
| SYM00965 | 82 | 835 | Rice | Ancient Landrace | Surface sterilized seeds | Xanthomonadaceae | *Luteibacter* sp. |
| SYM01167 | 82 | 941 | Rice | Ancient Landrace | Roots & Seeds | Xanthomonadaceae | *Luteibacter* sp. |
| SYM00940 | 83 | 815 | Rice | Modern | Surface sterilized seeds | Enterobacteriaceae | |
| SYM00941 | 83 | 816 | Rice | Modern | Surface sterilized seeds | Enterobacteriaceae | |
| SYM00963 | 83 | 833 | Rice | Ancient Landrace | Surface sterilized seeds | Enterobacteriaceae | |
| SYM00972 | 83 | 841 | Rice | Ancient Landrace | Surface sterilized seeds | Enterobacteriaceae | |
| SYM00987 | 83 | 853 | Rice | Modern | Surface sterilized seeds | Enterobacteriaceae | |
| SYM00713 | 84 | 749 | Rice | Modern | Seed surface wash | Enterobacteriaceae | *Erwinia* sp. |
| SYM00945 | 84 | 820 | Rice | Modern | Surface sterilized seeds | Enterobacteriaceae | |
| SYM01103 | 84 | 914 | Rice | Modern | Surface sterilized seeds | Enterobacteriaceae | |
| SYM01138 | 84 | 926 | *Oryza latifolia* | Wild relative | Roots & Seeds | Enterobacteriaceae | |
| SYM01139 | 84 | 927 | *Oryza latifolia* | Wild relative | Roots & Seeds | Enterobacteriaceae | |
| SYM01180 | 84 | 950 | Rice | Modern | Roots & Seeds | Enterobacteriaceae | |
| SYM01189 | 84 | 958 | Rice | Modern | Roots & Seeds | Enterobacteriaceae | |
| SYM01193 | 84 | 961 | Rice | Modern | Roots & Seeds | Enterobacteriaceae | |
| SYM01226 | 84 | 976 | Rice | Modern | Roots & Seeds | Enterobacteriaceae | |
| SYM01229 | 84 | 978 | Rice | Modern | Roots & Seeds | Enterobacteriaceae | *Pantoea* sp. |
| SYM01230 | 84 | 979 | Rice | Modern | Roots & Seeds | Enterobacteriaceae | |
| SYM00992 | 126 | 856 | *Oryza officinalis* | Wild relative | Surface sterilized seeds | Sphingomonadaceae | *Sphingomonas* sp. |
| SYM00063 | 134 | 559 | Teosinte | Wild relative | Surface sterilized seeds | Microbacteriaceae | *Microbacterium* sp. |
| SYM00226 | 134 | 618 | Soybean | Modern | Leaves | Microbacteriaceae | *Microbacterium* sp. |
| SYM00246 | 134 | 627 | Barley | Modern | Surface sterilized seeds | Microbacteriaceae | *Microbacterium* sp. |
| SYM00524 | 134 | 653 | *Oryza nivara* | Wild relative | Seed surface wash | Microbacteriaceae | *Microbacterium* sp. |
| SYM00694a | 134 | 743 | Rice | Modern | Seed surface wash | Microbacteriaceae | *Microbacterium* sp. |
| SYM01234 | 134 | 983 | *Oryza officinalis* | Wild relative | Roots & Seeds | Microbacteriaceae | *Microbacterium* sp. |

TABLE 2-continued

Endophytic bacteria isolated from corn, rice and wheat seeds, including assignment to specific OTUs, corresponding Sequence ID numbers, Family, Genus, Taxonomic information and plant source from which the microbe was derived.

| SYM # | OTU# | SEQ ID NO: | Seed Crop Type | Seed Cultivar Type | Source of seed microbes | Family of Seed Microbe | Taxonomy of Seed Microbe |
|---|---|---|---|---|---|---|---|
| SYM00199 | 135 | 1448 | Maize | Maize | Roots | Bacillaceae | *Bacillus* sp. |
| SYM00172 | 146 | 592 | Rice | Modern | Surface sterilized seeds | Enterobacteriaceae | *Pantoea* sp. |
| SYM00527 | 146 | 655 | *Oryza nivara* | Wild relative | Seed surface wash | Enterobacteriaceae | *Erwinia* sp. |
| SYM00644 | 146 | 728 | Rice | Modern | Seed surface wash | Enterobacteriaceae | *Erwinia* sp. |
| SYM00648 | 146 | 732 | Rice | Modern | Seed surface wash | Enterobacteriaceae | |
| SYM00966 | 146 | 836 | Rice | Ancient Landrace | Surface sterilized seeds | Enterobacteriaceae | |
| SYM00978 | 146 | 846 | Rice | Ancient Landrace | Surface sterilized seeds | Enterobacteriaceae | |
| SYM00981 | 146 | 848 | Rice | Modern | Surface sterilized seeds | Enterobacteriaceae | |
| SYM01011 | 146 | 870 | Rice | Ancient Landrace | Surface sterilized seeds | Enterobacteriaceae | *Erwinia* sp. |
| SYM01159 | 146 | 938 | *Avena sterilis* | Wild relative | Roots & Seeds | Enterobacteriaceae | |
| SYM01175 | 146 | 945 | Rice | Ancient Landrace | Roots & Seeds | Enterobacteriaceae | |
| SYM01232 | 146 | 981 | Rice | Modern | Roots & Seeds | Enterobacteriaceae | |
| SYM01244 | 146 | 987 | Rice | Ancient Landrace | Roots & Seeds | Enterobacteriaceae | |
| SYM00538A | 172 | 658 | Maize | Ancient Landrace | Seed surface wash | Sphingomonadaceae | *Sphingomonas* sp. |
| SYM00508 | 196 | 646 | Maize | Ancient Landrace | Seed surface wash | Enterobacteriaceae | |

Legend: For "Source of seed microbe" "Surface sterilized seeds" = seed microbes isolated from seeds that were surface sterilized as described in the Examples; "Seed surface wash" = microbes derived from the surface of seeds as described in the Examples; "Roots" = seed microbes isolated from roots of seeds that were germinated in sterile culture; "Roots & Seeds" = seed microbes isolated from roots and residual seed material that was generated by germinating seeds under sterile conditions; "Leaves" = seed microbes isolated from shoots and leaves that emerged from seeds that were germinated under sterile conditions.

As used herein, seed endophytes can be obtained from seeds of many distinct plants. In one embodiment, the endophyte can be obtained from the seed of the same or different crop, and can be from the same or different cultivar or variety as the seed onto which it is to be coated. For example, seed endophytes from a particular corn variety can be isolated and coated onto the surface of a corn seed of the same variety. In one particular embodiment, the seed of the first plant that is to be coated with the endophyte can comprise a detectable amount of the same endophyte in the interior of the seed. In another embodiment, the seed of the first plant that is to be coated with the endophyte can comprise a detectable amount of the same endophyte in the exterior of the seed. For example, an uncoated reference seed may contain a detectable amount of the same endophyte within its seed. In yet another embodiment, the endophyte to be coated onto the seed of the plant is a microbe or of a microbial taxa that is detectably present in the interior and exterior of the seed from which the endophyte is derived.

In another embodiment, the endophyte can be obtaine from a related species (e.g., an endophyte isolated from *Triticum monococcum* (einkorn wheat) can be coated onto the surface of a *T. aestivum* (common wheat) seed; or, an endophyte from *Hordeum vulgare* (barley) can be isolated and coated onto the seed of a member of the Triticeae family, for example, seeds of the rye plant, *Secale cereale*). In still another embodiment, the endophyte can be isolated from the seed of a plant that is distantly related to the seed onto which the endophyte is to be coated. For example, a tomato-derived endophyte can be isolated and coated onto a rice seed.

In some embodiments, the present invention contemplates the use of endophytes that can confer a beneficial agronomic trait upon the seed or resulting plant onto which it is applied, e.g., coated, sprayed, dipped, or immersed. In another embodiment, the seed endophytes useful for the present invention can also be isolated from seeds of plants adapted to a particular environment, including, but not limited to, an environment with water deficiency, salinity, acute and/or chronic heat stress, acute and/or chronic cold stress, nutrient deprived soils including, but not limited to, micronutrient deprived soils, macronutrient (e.g., potassium, phosphate, and/or nitrogen) deprived soils, or pathogen stress, including fungal, nematode, insect, viral, or bacterial pathogen stress. In one example, the endophyte is isolated from the seed of a plant that grows in a water deficient environment.

The synthetic combination of the present invention contemplates the presence of an endophyte on the surface of the seed of the first plant. In one embodiment, the seed of the first plant is contacted with, e.g., coated with, at least 10 CFU of the endophyte per seed, for example, at least 20 CFU, at least 50 CFU, at least 100 CFU, at least 200 CFU, at least 300 CFU, at least 500 CFU, at least 1,000 CFU, at least 3,000 CFU, at least 10,000 CFU, at least 30,000 or more per seed. In another embodiment, the seed is coated with at least 10, for example, at least 20, at least 50, at least 100, at least 200, at least 300, at least 500, at least 1,000, at least 3,000, at least 10,000, at least 30,000, at least 100,000, at least 300,000, at least 1,000,000 or more of the endophyte as detected by the number of copies of a particular endophyte gene detected, for example, by quantitative PCR.

In some cases, the seed endophyte is of monoclonal origin, providing high genetic uniformity of the endophyte population in an agricultural formulation or within a synthetic seed or plant combination with the endophyte.

In some cases, the bacterial endophytes described herein are capable of moving from one tissue type to another. For example, the present invention's detection and isolation of seed endophytes within the mature tissues of cereal or soy plants after coating on the exterior of a seed demonstrates their ability to move from seed exterior into the vegetative tissues of a maturing plant. Therefore, in one embodiment, the population of bacterial endophytes is capable of moving from the seed exterior into the vegetative tissues of a grass plant. In one embodiment, the seed endophyte which is coated onto the seed of a plant is capable, upon germination of the seed into a vegetative state, of localizing to a different tissue of the plant. For example, the endophyte can be capable of localizing to any one of the tissues in the plant, including: the root, adventitious root, seminal root, root hair, shoot, leaf, flower, bud, tassel, meristem, pollen, pistil, ovaries, stamen, fruit, stolon, rhizome, nodule, tuber, trichome, guard cells, hydathode, petal, sepal, glume, rachis, vascular cambium, phloem, and xylem. In one embodiment, the endophyte is capable of localizing to the root and/or the root hair of the plant. In another embodiment, the endophyte is capable of localizing to the photosynthetic tissues, for example, leaves and shoots of the plant. In other cases, the endophyte is localized to the vascular tissues of the plant, for example, in the xylem and phloem. In still another embodiment, the endophyte is capable of localizing to the reproductive tissues (flower, pollen, pistil, ovaries, stamen, or fruit) of the plant. In another embodiment, the endophyte is capable of localizing to the root, shoots, leaves and reproductive tissues of the plant. In still another embodiment, the endophyte colonizes a fruit or seed tissue of the plant. In still another embodiment, the endophyte is able to colonize the plant such that it is present in the surface of the plant (i.e., its presence is detectably present on the plant exterior, or the episphere of the plant). In still other embodiments, the endophyte is capable of localizing to substantially all, or all, tissues of the plant. In certain embodiments, the endophyte is not localized to the root of a plant. In other cases, the endophyte is not localized to the photosynthetic tissues of the plant.

In some cases, the bacterial endophytes are capable of replicating within the host grass plant and colonizing the grass plant.

In addition, the bacterial endophytes described herein provide several key significant advantages over other plant-associated microbes.

Different environments can contain significantly different populations of endophytes and thus may provide reservoirs for desired seed endophytes. Once a choice environment is selected, seeds of choice plants to be sampled can be identified by their healthy and/or robust growth, and can then be sampled at least 5 at a time by excavating the entire plants plus small root ball including roots and associated soil and any seeds or fruit present on the plant. The excavated material can be placed in a cool (4° C. environment) for storage, and then extraction of endophytes and DNA can be performed using methods described herein. Identification of choice environments or ecosystems for bioprospecting of plant associated endophytes from either wild plants or crop plants growing in the choice environments or ecosystems follows protocols described herein.

In one embodiment, the endophyte-associated plant is harvested from a soil type different than the normal soil type that the crop plant is grown on, for example from a gelisol (soils with permafrost within 2 m of the surface), for example from a histosol (organic soil), for example from a spodosol (acid forest soils with a subsurface accumulation of metal-humus complexes), for example from an andisol (soils formed in volcanic ash), for example from a oxisol (intensely weathered soils of tropical and subtropical environments), for example from a vertisol (clayey soils with high shrink/swell capacity), for example from an aridisol ($CaCO_3$-containing soils of arid environments with subsurface horizon development), for example from a ultisol (strongly leached soils with a subsurface zone of clay accumulation and <35% base saturation), for example from a mollisol (grassland soils with high base status), for example from an alfisol (moderately leached soils with a subsurface zone of clay accumulation and >35% base saturation), for example from a inceptisol (soils with weakly developed subsurface horizons), or for example from a entisol (soils with little or no morphological development).

In another embodiment, the endophyte-associated plant is harvested from an ecosystem where the agricultural plant is not normally found, for example, a tundra ecosystem as opposed to a temperate agricultural farm, for example from tropical and subtropical moist broadleaf forests (tropical and subtropical, humid), for example from tropical and subtropical dry broadleaf forests (tropical and subtropical, semihumid), for example from tropical and subtropical coniferous forests (tropical and subtropical, semihumid), for example from temperate broadleaf and mixed forests (temperate, humid), for example from temperate coniferous forests (temperate, humid to semihumid), from for example from boreal forests/taiga (subarctic, humid), for example from tropical and subtropical grasslands, savannas, and shrublands (tropical and subtropical, semiarid), for example from temperate grasslands, savannas, and shrublands (temperate, semiarid), for example from flooded grasslands and savannas (temperate to tropical, fresh or brackish water inundated), for example from montane grasslands and shrublands (alpine or montane climate), for example from Mediterranean forests, woodlands, and scrub or sclerophyll forests (temperate warm, semihumid to semiarid with winter rainfall), for example from mangrove forests, and for example from deserts and xeric shrublands (temperate to tropical, arid).

In another embodiment, the endophyte-associated plant is harvested from a soil with an average pH range that is different from the optimal soil pH range of the crop plant, for example the plant may be harvested from an ultra acidic soil (<3.5), from an extreme acid soil (3.5-4.4), from a very strong acid soil (4.5-5.0), from a strong acid soil (5.1-5.5), from a moderate acid soil (5.6-6.0), from an slight acid soil (6.1-6.5), from an neutral soil (6.6-7.3), from an slightly alkaline soil (7.4-7.8), from an moderately alkaline soil (7.9-8.4), from a strongly alkaline soil (8.5-9.0), or from an very strongly alkaline soil (>9.0).

In one embodiment, the endophyte-associated plant is harvested from an environment with average air temperatures lower than the normal growing temperature of the crop plant, for example 2-5° C. colder than average, for example, at least 5-10° C. colder, at least 10-15° C. colder, at least at least 15-20° C. colder, at least 20-25° C. colder, at least 25-30° C. colder, at least 30-35° C. colder, at least 35-40° C. colder, at least 40-45° C. colder, at least 45-50° C. colder, at least 50-55° C. colder or more, when compared with crop plants grown under normal conditions during an average growing season.

In one embodiment, the endophyte-associated plant is harvested from an environment with average air temperatures higher than the normal growing temperature of the crop plant, for example 2-5° C. hotter than average, for example, at least 5-10° C. hotter, at least 10-15° C. hotter, at least at least 15-20° C. hotter, at least 20-25° C. hotter, at least 25-30° C. hotter, at least 30-35° C. hotter, at least 35-40° C. hotter, at least 40-45° C. hotter, at least 45-50° C. hotter, at least 50-55° C. hotter or more, when compared with crop plants grown under normal conditions during an average growing season.

In another embodiment, the endophyte-associated plant is harvested from an environment with average rainfall lower than the optimal average rainfall received by the crop plant, for example 2-5% less rainfall than average, for example, at least 5-10% less rainfall, at least 10-15% less rainfall, at least 15-20% less rainfall, at least 20-25% less rainfall, at least 25-30% less rainfall, at least 30-35% less rainfall, at least 35-40% less rainfall, at least 40-45% less rainfall, at least 45-50% less rainfall, at least 50-55% less rainfall, at least 55-60% less rainfall, at least 60-65% less rainfall, at least 65-70% less rainfall, at least 70-75% less rainfall, at least 80-85% less rainfall, at least 85-90% less rainfall, at least 90-95% less rainfall, or less, when compared with crop plants grown under normal conditions during an average growing season.

In one embodiment, the endophyte-associated plant is harvested from an environment with average rainfall higher than the optimal average rainfall of the crop plant, for example 2-5% more rainfall than average, for example, at least 5-10% more rainfall, at least 10-15% more rainfall, at least 15-20% more rainfall, at least 20-25% more rainfall, at least 25-30% more rainfall, at least 30-35% more rainfall, at least 35-40% more rainfall, at least 40-45% more rainfall, at least 45-50% more rainfall, at least 50-55% more rainfall, at least 55-60% more rainfall, at least 60-65% more rainfall, at least 65-70% more rainfall, at least 70-75% more rainfall, at least 80-85% more rainfall, at least 85-90% more rainfall, at least 90-95% more rainfall, at least 95-100% more rainfall, or even greater than 100% more rainfall, or even greater than 200% more rainfall, or even greater than 300% more rainfall, or even greater than 400% more rainfall, or even greater than 500% more rainfall, when compared with crop plants grown under normal conditions during an average growing season.

In another embodiment, the endophyte-associated plant is harvested from a soil type with different soil moisture classification than the normal soil type that the crop plant is grown on, for example from an aquic soil (soil is saturated with water and virtually free of gaseous oxygen for sufficient periods of time, such that there is evidence of poor aeration), for example from an udic soil (soil moisture is sufficiently high year-round in most years to meet plant requirement), for example from an ustic soil (soil moisture is intermediate between udic and aridic regimes; generally, plant-available moisture during the growing season, but severe periods of drought may occur), for example from an aridic soil (soil is dry for at least half of the growing season and moist for less than 90 consecutive days), for example from a xeric soil (soil moisture regime is found in Mediterranean-type climates, with cool, moist winters and warm, dry summers).

In one embodiment, the endophyte-associated plant is harvested from an environment with average rainfall lower than the optimal average rainfall of the crop plant, for example 2-95% less rainfall than average, for example, at least 5-90% less rainfall, at least 10-85% less rainfall, at least 15-80% less rainfall, at least 20-75% less rainfall, at least 25-70% less rainfall, at least 30-65% less rainfall, at least 35-60% less rainfall, at least 40-55% less rainfall, at least 45-50% less rainfall, when compared with crop plants grown under normal conditions during an average growing season.

In one embodiment, the endophyte-associated plant is harvested from an environment with average rainfall higher than the optimal average rainfall of the crop plant, for example 2-5% more rainfall than average, for example, at least 5-10% more rainfall, at least 10-15% more rainfall, at least 15-20% more rainfall, at least 20-25% more rainfall, at least 25-30% more rainfall, at least 30-35% more rainfall, at least 35-40% more rainfall, at least 40-45% more rainfall, at least 45-50% more rainfall, at least 50-55% more rainfall, at least 55-60% more rainfall, at least 60-65% more rainfall, at least 65-70% more rainfall, at least 70-75% more rainfall, at least 80-85% more rainfall, at least 85-90% more rainfall, at least 90-95% more rainfall, at least 95-100% more rainfall, or even greater than 100% more rainfall, or even greater than 200% more rainfall, or even greater than 300% more rainfall, or even greater than 400% more rainfall, or even greater than 500% more rainfall, when compared with crop plants grown under normal conditions during an average growing season.

In another embodiment, the endophyte-associated plant is harvested from an agricultural environment with a crop yield lower than the average crop yield expected from the crop plant grown under average cultivation practices on normal agricultural land, for example 2-5% lower yield than average, for example, at least 5-10% lower yield, at least 10-15% lower yield, at least 15-20% lower yield, at least 20-25% lower yield, at least 25-30% lower yield, at least 30-35% lower yield, at least 35-40% lower yield, at least 40-45% lower yield, at least 45-50% lower yield, at least 50-55% lower yield, at least 55-60% lower yield, at least 60-65% lower yield, at least 65-70% lower yield, at least 70-75% lower yield, at least 80-85% lower yield, at least 85-90% lower yield, at least 90-95% lower yield, or less, when compared with crop plants grown under normal conditions during an average growing season.

In a related embodiment, the endophyte-associated plant is harvested from an agricultural environment with a crop yield lower than the average crop yield expected from the crop plant grown under average cultivation practices on normal agricultural land, for example 2-95% lower yield than average, for example, at least 5-90% lower yield, at least 10-85% lower yield, at least 15-80% lower yield, at least 20-75% lower yield, at least 25-70% lower yield, at least 30-65% lower yield, at least 35-60% lower yield, at least 40-55% lower yield, at least 45-50% lower yield, when compared with crop plants grown under normal conditions during an average growing season.

In one embodiment, the endophyte-associated plant is harvested from an environment with average crop yield higher than the optimal average crop yield of the crop plant, for example 2-5% more yield than average, for example, at least 5-10% more yield, at least 10-15% more yield, at least 15-20% more yield, at least 20-25% more yield, at least 25-30% more yield, at least 30-35% more yield, at least 35-40% more yield, at least 40-45% more yield, at least 45-50% more yield, at least 50-55% more yield, at least 55-60% more yield, at least 60-65% more yield, at least 65-70% more yield, at least 70-75% more yield, at least 80-85% more yield, at least 85-90% more yield, at least 90-95% more yield, at least 95-100% more yield, or even greater than 100% more yield, or even greater than 200% more yield, or even greater than 300% more yield, or even greater than 400% more yield, or even greater than 500% more yield, when compared with crop plants grown under normal conditions during an average growing season.

In a related embodiment, the endophyte-associated plant is harvested from an environment with average crop yield higher than the optimal average crop yield of the crop plant, 2-500% more yield than average, 2-400% more yield than average, 2-300% more yield than average, 2-200% more yield than average, 2-95% more yield than average, for example, at least 5-90% more yield, at least 10-85% more yield, at least 15-80% more yield, at least 20-75% more yield, at least 25-70% more yield, at least 30-65% more yield, at least 35-60% more yield, at least 40-55% more yield, at least 45-50% more yield, when compared with crop plants grown under normal conditions during an average growing season.

In another embodiment, the endophyte-associated plant is harvested from an environment where soil contains lower total nitrogen than the optimum levels recommended in order to achieve average crop yields for a plant grown under average cultivation practices on normal agricultural land, for example 2-5% less nitrogen than average, for example, at least 5-10% less nitrogen, at least 10-15% less nitrogen, at least 15-20% less nitrogen, at least 20-25% less nitrogen, at least 25-30% less nitrogen, at least 30-35% less nitrogen, at least 35-40% less nitrogen, at least 40-45% less nitrogen, at least 45-50% less nitrogen, at least 50-55% less nitrogen, at least 55-60% less nitrogen, at least 60-65% less nitrogen, at least 65-70% less nitrogen, at least 70-75% less nitrogen, at least 80-85% less nitrogen, at least 85-90% less nitrogen, at least 90-95% less nitrogen, or less, when compared with crop plants grown under normal conditions during an average growing season.

In another embodiment, the endophyte-associated plant is harvested from an environment where soil contains higher total nitrogen than the optimum levels recommended in order to achieve average crop yields for a plant grown under average cultivation practices on normal agricultural land, for example 2-5% more nitrogen than average, for example, at least 5-10% more nitrogen, at least 10-15% more nitrogen, at least 15-20% more nitrogen, at least 20-25% more nitrogen, at least 25-30% more nitrogen, at least 30-35% more nitrogen, at least 35-40% more nitrogen, at least 40-45% more nitrogen, at least 45-50% more nitrogen, at least 50-55% more nitrogen, at least 55-60% more nitrogen, at least 60-65% more nitrogen, at least 65-70% more nitrogen, at least 70-75% more nitrogen, at least 80-85% more nitrogen, at least 85-90% more nitrogen, at least 90-95% more nitrogen, at least 95-100% more nitrogen, or even greater than 100% more nitrogen, or even greater than 200% more nitrogen, or even greater than 300% more nitrogen, or even greater than 400% more nitrogen, or even greater than 500% more nitrogen, when compared with crop plants grown under normal conditions during an average growing season.

In another embodiment, the endophyte-associated plant is harvested from an environment where soil contains lower total phosphorus than the optimum levels recommended in order to achieve average crop yields for a plant grown under average cultivation practices on normal agricultural land, for example 2-5% less phosphorus than average, for example, at least 5-10% less phosphorus, at least 10-15% less phosphorus, at least 15-20% less phosphorus, at least 20-25% less phosphorus, at least 25-30% less phosphorus, at least 30-35% less phosphorus, at least 35-40% less phosphorus, at least 40-45% less phosphorus, at least 45-50% less phosphorus, at least 50-55% less phosphorus, at least 55-60% less phosphorus, at least 60-65% less phosphorus, at least 65-70% less phosphorus, at least 70-75% less phosphorus, at least 80-85% less phosphorus, at least 85-90% less phosphorus, at least 90-95% less phosphorus, or less, when compared with crop plants grown under normal conditions during an average growing season.

In another embodiment, the endophyte-associated plant is harvested from an environment where soil contains higher total phosphorus than the optimum levels recommended in order to achieve average crop yields for a plant grown under average cultivation practices on normal agricultural land, for example 2-5% more phosphorus than average, for example, at least 5-10% more phosphorus, at least 10-15% more phosphorus, at least 15-20% more phosphorus, at least 20-25% more phosphorus, at least 25-30% more phosphorus, at least 30-35% more phosphorus, at least 35-40% more phosphorus, at least 40-45% more phosphorus, at least 45-50% more phosphorus, at least 50-55% more phosphorus, at least 55-60% more phosphorus, at least 60-65% more phosphorus, at least 65-70% more phosphorus, at least 70-75% more phosphorus, at least 80-85% more phosphorus, at least 85-90% more phosphorus, at least 90-95% more phosphorus, at least 95-100% more phosphorus, or even greater than 100% more phosphorus, or even greater than 200% more phosphorus, or even greater than 300% more phosphorus, or even greater than 400% more phosphorus, or even greater than 500% more phosphorus, when compared with crop plants grown under normal conditions during an average growing season.

In another embodiment, the endophyte-associated plant is harvested from an environment where soil contains lower total potassium than the optimum levels recommended in order to achieve average crop yields for a plant grown under average cultivation practices on normal agricultural land, for example 2-5% less potassium than average, for example, at least 5-10% less potassium, at least 10-15% less potassium, at least 15-20% less potassium, at least 20-25% less potassium, at least 25-30% less potassium, at least 30-35% less potassium, at least 35-40% less potassium, at least 40-45% less potassium, at least 45-50% less potassium, at least 50-55% less potassium, at least 55-60% less potassium, at least 60-65% less potassium, at least 65-70% less potassium, at least 70-75% less potassium, at least 80-85% less potassium, at least 85-90% less potassium, at least 90-95% less potassium, or less, when compared with crop plants grown under normal conditions during an average growing season.

In another embodiment, the endophyte-associated plant is harvested from an environment where soil contains higher total potassium than the optimum levels recommended in order to achieve average crop yields for a plant grown under average cultivation practices on normal agricultural land, for example 2-5% more potassium than average, for example, at least 5-10% more potassium, at least 10-15% more potassium, at least 15-20% more potassium, at least 20-25% more potassium, at least 25-30% more potassium, at least 30-35% more potassium, at least 35-40% more potassium, at least 40-45% more potassium, at least 45-50% more potassium, at least 50-55% more potassium, at least 55-60% more potassium, at least 60-65% more potassium, at least 65-70% more potassium, at least 70-75% more potassium, at least 80-85% more potassium, at least 85-90% more potassium, at least 90-95% more potassium, at least 95-100% more potassium, or even greater than 100% more potassium, or even greater than 200% more potassium, or even greater than 300% more potassium, or even greater than 400% more potassium, or even greater than 500% more potassium, when compared with crop plants grown under normal conditions during an average growing season.

In another embodiment, the endophyte-associated plant is harvested from an environment where soil contains lower total sulfur than the optimum levels recommended in order to achieve average crop yields for a plant grown under average cultivation practices on normal agricultural land, for example 2-5% less sulfur than average, for example, at least 5-10% less sulfur, at least 10-15% less sulfur, at least 15-20% less sulfur, at least 20-25% less sulfur, at least 25-30% less sulfur, at least 30-35% less sulfur, at least 35-40% less sulfur, at least 40-45% less sulfur, at least 45-50% less sulfur, at least 50-55% less sulfur, at least 55-60% less sulfur, at least 60-65% less sulfur, at least 65-70% less sulfur, at least 70-75% less sulfur, at least 80-85% less sulfur, at least 85-90% less sulfur, at least 90-95% less sulfur, or less, when compared with crop plants grown under normal conditions during an average growing season.

In another embodiment, the endophyte-associated plant is harvested from an environment where soil contains higher total sulfur than the optimum levels recommended in order to achieve average crop yields for a plant grown under average cultivation practices on normal agricultural land, for example 2-5% more sulfur than average, for example, at least 5-10% more sulfur, at least 10-15% more sulfur, at least 15-20% more sulfur, at least 20-25% more sulfur, at least 25-30% more sulfur, at least 30-35% more sulfur, at least 35-40% more sulfur, at least 40-45% more sulfur, at least 45-50% more sulfur, at least 50-55% more sulfur, at least 55-60% more sulfur, at least 60-65% more sulfur, at least 65-70% more sulfur, at least 70-75% more sulfur, at least 80-85% more sulfur, at least 85-90% more sulfur, at least 90-95% more sulfur, at least 95-100% more sulfur, or even greater than 100% more sulfur, or even greater than 200% more sulfur, or even greater than 300% more sulfur, or even greater than 400% more sulfur, or even greater than 500% more sulfur, when compared with crop plants grown under normal conditions during an average growing season.

In another embodiment, the endophyte-associated plant is harvested from an environment where soil contains lower total calcium than the optimum levels recommended in order to achieve average crop yields for a plant grown under average cultivation practices on normal agricultural land, for example 2-5% less calcium than average, for example, at least 5-10% less calcium, at least 10-15% less calcium, at least 15-20% less calcium, at least 20-25% less calcium, at least 25-30% less calcium, at least 30-35% less calcium, at least 35-40% less calcium, at least 40-45% less calcium, at least 45-50% less calcium, at least 50-55% less calcium, at least 55-60% less calcium, at least 60-65% less calcium, at least 65-70% less calcium, at least 70-75% less calcium, at least 80-85% less calcium, at least 85-90% less calcium, at least 90-95% less calcium, or less, when compared with crop plants grown under normal conditions during an average growing season.

In another embodiment, the endophyte-associated plant is harvested from an environment where soil contains lower total magnesium than the optimum levels recommended in order to achieve average crop yields for a plant grown under average cultivation practices on normal agricultural land, for example 2-5% less magnesium than average, for example, at least 5-10% less magnesium, at least 10-15% less magnesium, at least 15-20% less magnesium, at least 20-25% less magnesium, at least 25-30% less magnesium, at least 30-35% less magnesium, at least 35-40% less magnesium, at least 40-45% less magnesium, at least 45-50% less magnesium, at least 50-55% less magnesium, at least 55-60% less magnesium, at least 60-65% less magnesium, at least 65-70% less magnesium, at least 70-75% less magnesium, at least 80-85% less magnesium, at least 85-90% less magnesium, at least 90-95% less magnesium, or less, when compared with crop plants grown under normal conditions during an average growing season.

In another embodiment, the endophyte-associated plant is harvested from an environment where soil contains higher total sodium chloride (salt) than the optimum levels recommended in order to achieve average crop yields for a plant grown under average cultivation practices on normal agricultural land, for example 2-5% more salt than average, for example, at least 5-10% more salt, at least 10-15% more salt, at least 15-20% more salt, at least 20-25% more salt, at least 25-30% more salt, at least 30-35% more salt, at least 35-40% more salt, at least 40-45% more salt, at least 45-50% more salt, at least 50-55% more salt, at least 55-60% more salt, at least 60-65% more salt, at least 65-70% more salt, at least 70-75% more salt, at least 80-85% more salt, at least 85-90% more salt, at least 90-95% more salt, at least 95-100% more salt, or even greater than 100% more salt, or even greater than 200% more salt, or even greater than 300% more salt, or even greater than 400% more salt, or even greater than 500% more salt, when compared with crop plants grown under normal conditions during an average growing season.

Plants Useful for the Present Invention

In some embodiments, a bacterial endophyte can be introduced into a *Glycine* plant (e.g., a *Glycine max* plant or a wild soybean such as *Glycine soja*) or an agricultural grass plant, i.e., a plant of the family Graminae (grasses). The grass plants into which the bacterial endophyte can be introduced may be any of the useful grasses belonging to the genera *Agropyron, Agrostis, Andropogon, Anthoxanthum, Arrhenatherum, Avena, Brachypodium, Bromus, Chloris, Cynodon, Dactylis, Elymus, Eragrostis, Festuca, Glyceria, Hierochloe, Hordeum, Lolium, Oryza, Panicum, Paspalum, Phalaris, Phleum, Poa, Setaria, Sorghum, Triticum, Zea* and *Zoysia*.

In another embodiment, the target plant is selected from the wheats, including, *Triticum monococcum, Triticum durum, Triticum turgidum, Triticum timopheevi* (Timopheevs Wheat) and *Triticum aestivum* (Bread Wheat).

In another embodiment, the target plant is a corn of the genus *Zea*. *Zea* is a genus of the family Graminae (also referred to as Poaceae), commonly known as the grass family. The genus consists of some four species: *Zea mays*, cultivated corn and teosinte; *Zea diploperennis* Iltis et at., diploperennial teosinte; *Zea luxurians* (Durieu et Asch.) Bird; and *Zea perennis* (Hitchc.) Reeves et Mangelsd., perennial teosinte.

Accordingly, in one embodiment, the plant is selected from the group of Graminae (grasses), including grasses of the genera *Agropyron, Agrostis, Andropogon, Anthoxanthum, Arrhenatherum, Avena, Brachypodium, Bromus, Chloris, Cynodon, Dactylis, Elymus, Eragrostis, Festuca, Glyceria, Hierochloe, Hordeum*, including *Hordeum vulgare* L., *Hordeum distichon* L., and *Hordeum irregulare, Lolium, Oryza, Panicum, Paspalum, Phalaris, Phleum, Poa, Setaria, Sorghum, Triticum, Zea*, especially *Zea mays*, cultivated corn and teosinte, *Zea diploperennis* Iltis et at., diploperennial teosinte, *Zea luxurians* (Durieu et Asch.) Bird; and *Zea perennis* (Hitchc.) Reeves et Mangelsd., perennial teosinte, and *Zoysia*; wheats, including *Triticum monococcum, Triticum turgidum, Triticum timopheevi* (Timopheevs Wheat) and *Triticum aestivum* (Bread Wheat); rye grasses and bluegrasses, especially Kentucky bluegrass, Canada bluegrass, rough meadow grass, bulbous meadow grass, alpine meadow grass, wavy meadow grass, wood meadow grass, Balforth meadow grass, swamp meadow grass, broad leaf meadow grass, narrow leaf meadow grass, smooth meadow grass, spreading meadow grass and flattened meadow grass.

Commercial cultivars of agricultural plants can be used in the methods and compositions as described herein. Non-limiting examples of commercial cultivars are provided below.

Soybean

Exemplary soybean cultivars provided herein include 900Y71, 90Y42, P05T24R, 90Y80, 91M01, 91Y01, P10T91R, 91M10, 91Y20, 91Y61, 91Y90, P19T01R, 92Y12, 92Y21, 92Y31, 92Y32, P24T19R, 92Y51, 92Y91, 93M11, and 93Y22 from Pioneer Hi-Bred, which are grown in geographical entities including Iowa.

Exemplary soybean cultivars provided herein include 92Y51, 92Y53, P25T51R, P26T76R, 92M72, 92Y75, 92Y80, P28T33R, 93Y05, 93Y15, 93Y20, 93Y21, 93Y25, 93M42, 93Y40, 93Y41, 93Y43, P34T35L, P35T58R, 93Y60, 93Y72, 93B82, 93Y82, 93Y84, 93L71, P39T67R, 94Y01, 94Y21, 94Y23, 94Y50, 94Y70, and 95Y10 from Pioneer Hi-Bred, which are grown in geographical entities including Illinois.

Exemplary soybean cultivars provided herein include 91Y90, 92Y22, P24T19R, 92Y53, 92Y62, 92M72, 92Y70, 92Y73, 92Y83, 93M11, 93Y13, 93Y15, 93M43, 93Y41, 93Y52, P35T58R, 93M61, 93Y70, 93Y72, 93B82, 93Y84, 93Y92, P39T67R, 94Y01, and 94Y02 from Pioneer Hi-Bred, which are grown in geographical entities including Nebraska.

Exemplary soybean cultivars provided herein include 90Y51, 90Y90, 92Y51, 92Y75, 92Y80, P28T33R, 93Y05, 93Y11, 93Y20, 93Y21, 93Y22, 93Y23, P33T89R, 93M42, 93Y40, 93Y41, 93Y43, P34T35L, 93Y51, 93Y53, P35T58R, 93Y60, 93Y72, 93B82, 93Y82, 93Y84, 93L71, 93Y91, 93Y92, P39T67R, 94Y01, 94Y02, 94L21, 94Y21, 94Y22, 94Y23, 94L51, P43T14L, P44T82SR, 94Y50, P46T21R, 94Y70, P47T36R, 94Y80, and P48T53R from Pioneer Hi-Bred, which are grown in geographical entities including Indiana.

Exemplary soybean cultivars provided herein include AG 0231 GENRR2Y, AG 0333 GENRR2Y, AG 0430 GENRR2Y, AG 0532 GENRR2Y, AG 0732 GENRR2Y, AG 0832 GENRR2Y, AG 0833 GENRR2Y, AG 1031 GENRR2Y, AG 1132 GENRR2Y, AG 1230 GENRR2Y, AG 1233 GENRR2Y, and AG 1431 GENRR2Y from Asgrow, which are grown in geographical entities including the United States.

Exemplary soybean cultivars provided herein include S06-H5, 508-G1, S10-G7, S10-P9, S12-L5, S14-J7, S17-B3, S17-G8, S18-C2, S20-T6, S20-Y2, S22-F8, S22-51, S23-P8, S24-K2, S25-E5, S27-H6, S28-A2, S28-K1, S28-U7, S29-V2, S30-E9, S34-N3, S34-Z1, S35-C3, S36-M8, S17-B3, S18-C2, S20-T6, S20-Y2, S22-F8, S22-S1, S24-K2, S25-E5, S27-H6, S28-A2, S28-U7, S29-V2, S30-E9, S31-L7, S34-N3, S34-Z1, S35-C3, S36-M8, S37-B1, S38-S4, S38-W4, S39-U2, S41-J6, S42-W9, S43-K1, and S44-K7 from Syngenta, which are grown in geographical entities including the United States.

Maize

Exemplary *Zea* cultivars provided herein include 39V07, 38H03AM1, P9675, P9675YXR, P9630AM1, P9990AM1, P9917, P9917AM1, P9910AM1, P9910AMRW, P9910AMX, P9910XR, P0062AMX, P0062XR, P0193AM, P0193HR, P0216HR, P0210HR, 36V51, 36V52, 36V53, 36V59, P0313AM1, P0313XR, P0463AM1, P0461AMX, P0461EXR, P0461XR, P0453AM, P0453HR, P0448, P0448AMRW, P0448AMX, P0448E, P0448EHR, P0448R, P0413AM1, P0413E, P0407AMXT, P0533AM1, P0533EXR, P0528AMX, P0528YXR, 35F40, P0652AMX, P0636AM1, P0636HR, P0621HR, P0621R, P0717HR, P0832AM1, P0832E, P0832EXR, P0832XR, 34F29, P0993AM1, P0993HR, P0993XR, P0987AM1, P0987HR, P0916EHR, 34R6, 7P1023AM-R, P1018EHR, P1018HR, 34F06, 34F07, P1184, P1162AM1, P1162AMRW-R, P1162AMX-R, P1162EXR, P1162XR, P1151AM, P1151AM1, P1151R, P1142AMX, 33W80, 33W82, 33W84, 33W88AM1, P1281HR, P1253E, P1248AM, P1221AMX, P1221AMXT, P1215AM1, P1395, P1395AM1, P1395HR, P1395R, P1376XR, P1365AMX, P1360CHR, P1360HR, P1339AM1, P1324HR, 33Z74, 33T56, 33T57, 33M16, P1498, P1498AM, P1498HR, P1498R, P1480HR, P1477WHR, P1431W, P1431WR, P1420HR, 33G61, 33F12, P1555CHR, 33D42, 33D46, 33D49, P1659W, P1659WHR, 32D78, P1745HR, 32B16, P1995W, and P2088HR from Pioneer Hi-Bred, which are grown in geographical entities including Iowa. Exemplary *Zea* cultivars provided herein include P0115AM1, P0392AMX, P0496AMX, P0432AM1, P0413AM1, P0413AMRW, P0413E, P0413R, P0533AM1, P0636AM1, P0636YXR, 35K01, 35K02, 35K08, 35K09AM1, 35K10AMRW, 34M78, P0858AMX, P0832AMRW, P0832AMX, P0832E, P0832EXR, P0832R, P0993AM1, P0993HR, P0987AM1, P0987YXR, P0945YXR, P0916EHR, 34R65, P1023AM-R, P1023AMX-R, P1018AM, P1018AM1, P1018AMX, P1018E, P1018R, P1184, P1184AM, P1184AM1, P1184AMRW, P1184R, P1162AM1, P1162AMRW-R, P1162AMX-R, P1162EXR, P1151AM, P1151AM1, 34P91, P1292AMX, P1241AMX, P1221AMX, P1221AMXT, P1215AM1, P1395AM1, P1395AMRW, P1376XR, P1360CHR, P1360HR, P1352AMX, P1339AM1, P1319, P1319AM1, P1319HR, 33T55, 33T56, P1498, P1498AM, P1498CHR, P1498HR, P1498R, P1477W, P1477WHR, P1449XR, P1431W, P1431WR, 33F12, 33D42, P1690HR, P1659W, 32B09, 32B10, 32B16, P1995W, P1995WR, and P2088AM from Pioneer Hi-Bred, which are grown in geographical entities including Illinois.

Exemplary *Zea* cultivars provided herein include P8917XR, P9690AM, P9690HR, P0125R, P0231HR, P0365YHR, P0302CHR, P0474AM1, P0461EXR, P0591AM1, P0541AM1, P0541HR, 35F37, 35F38, 35F48AM1, 35F50AM, P0636AM1, P0636HR, P0636YXR, P0621HR, 35K01, P0876AM, P0876CHR, P0876HR, P0987, P0987AM, P0987AM1, P0987HR, P0987R, P0987YXR, P0916EHR, P0902AM1, P1023AM-R, P1023AMX-R, P1018EHR, P1173AM, P1173CHR, P1173HR, P1173R, P1151AM, P1151AM1, P1151HR, P1151R, P1151YXR, P1105YHR, P1292ER, P1266YHR, P1395AM, P1395AM1, P1395R, P1376XR, P1360HR, P1324HR, P1498AM, P1498AM1, P1498HR, P1498R, P1477W, P1477WHR, P1449XR, P1431W, 33G60, 33G61, 33F12, P1508CHR, 32T16, 33D42, 33D46, 33D47, 33D49, 33D53AM-R, 32T82, 32T84, P1690AM, P1690CHR, P1690HR, P1659W, P1659WHR, P1625CHR, P1625HR, P1768AMX, 32N74AM1, 32B09, 32B10, 32B11, 32B16, P1995W, P1995WR, 31G67AM1, 31G71, P2088AM, P2088YHR, and P2088YXR from Pioneer Hi-Bred, which are grown in geographical entities including Nebraska.

Exemplary *Zea* cultivars provided herein include P9690HR, P0115AM1, P0216HR, P0448E, P0432AM1, P0413AM1, P0413E, P0636AM1, P0636HR, P0636YHR, P0621HR, 35K01, 35K02, 35K08, 35K09AM1, 35K10AMRW, 34M78, P0858AMX, P0832AMX, P0832E, P0832R, P0993AM1, P0993HR, P0987, P0987AM, P0987AM1, P0987HR, P0987YXR, P0945YXR, P0916EHR, P1023AM-R, P1023AMX-R, P1018AM, P1018AM1, P1018AMX, P1018E, P1018R, P1184, P1184AM, P1184AM1, P1184R, P1162AM1, P1162AMRW-R, P1162AMX-R, P1151AM, P1151AM1, P1105YHR, 34P91, P1253E, P1221AMX, P1221AMXT, P1395, P1395AMRW, P1395HR, P1395R, P1376XR, P1360AM, P1360HR, P1352AMX, P1339AM1, P1319, P1319AM1, P1319HR, 33T54, 33T55, 33T56, 33T57, 33N58, P1498, P1498AM, P1498CHR, P1498HR, P1498R, P1477W, P1477WHR, P1449XR, P1431W, P1431WR, 33G60, 33F12, P1659W, P1659WHR, P1646YHR, P1636AM, P1636YHR, P1602YHR, 32D78, 32D79, P1745HR, 32B09, 32B10, 32B16, P1995W, P1995WR, 31P41, and P2088AM from Pioneer Hi-Bred, which are grown in geographical entities including Indiana.

Exemplary *Zea* cultivars provided herein include Gentry® SmartStax® RIB Complete®, including DKC48-12RIB Brand, DKC49-29RIB Brand, DKC53-56RIB Brand, DKC62-08RIB Brand, DKC63-33RIB Brand; DEKALB®

Genuity® DroughtGard™ Hybrids, including DKC47-27RIB Brand, DKC50-57RIB Brand, DKC51-20RIB Brand, DKC63-55RIB Brand, DKC65-81RIB Brand; <89 Relative Maturity, including DKC31-10RIB Brand, DKC32-92RIB Brand, DKC33-78RIB Brand, DKC38-03RIB Brand, DKC39-07RIB Brand; 90-99 Relative Maturity, including DKC43-10RIB Brand, DKC44-13RIB Brand, DKC46-20RIB Brand, DKC48-12RIB Brand, DKC49-29RIB Brand; 101-103 Relative Maturity, including DKC51-20RIB Brand, DKC52-30RIB Brand, DKC53-56RIB Brand, DKC53-58RIB Brand, DKC53-78RIB Brand; 104-108 Relative Maturity, including DKC54-38RIB Brand, DKC57-75RIB Brand, DKC57-92RIB Brand, DKC58-87RIB Brand, DKC58-89RIB Brand; 110-111 Relative Maturity, including DKC60-63RIB Brand, DKC60-67RIB Brand, DKC61-16RIB Brand, DKC61-88RIB Brand, DKC61-89RIB Brand; 112-113 Relative Maturity, including DKC62-08RIB Brand, DKC62-97RIB Brand, DKC63-07RIB Brand, DKC63-33RIB Brand, DKC63-55RIB Brand; 114-116 Relative Maturity, including DKC64-69RIB Brand, DKC64-87RIB Brand, DKC65-19RIB Brand, DKC65-79RIB Brand, DKC66-40RIB Brand; 117+Relative Maturity, including DKC67-57RIB Brand, DKC67-58RIB Brand, DKC67-88RIB Brand, DKC68-05 Brand, and DKC69-29 Brand from DEKALB®, which are grown in geographical entities including the United States.

Wheat

Exemplary *Triticum* cultivars provided herein include Everest, TAM 111, Armour, TAM 112, Fuller, Duster, T158, Postrock, Endurance, Jagger, Winter Hawk, Art, Overley, Jagalene, Jackpot, Hatcher, Santa Fe, Danby, Billings, T81, TAM 110, AP503 CL2, Aspen, 2137, TAM 113, Hitch, TAM 101, CJ, Centerfield, SY Gold, and Above, which are grown in geographical entities including Kansas.

Exemplary *Triticum* cultivars provided herein include Barlow, Glenn, SY Scren, Faller, Prosper, Kelby, Brennan, RB07, Vantage, WB Mayville, Freyr, Jenna, Mott, Select, Steele-ND, Briggs, Howard, Reeder, Alsen, Rollag, Divide, Alkabo, Mountrail, Tioga, Lebsock, Grenora, Dilse, Ben, DG Max, Pierce, Monroe, DG Star, Jerry, Decade, Hawken, Wesley, Overland, CDC Falcon, SY Wolf, Harding, Darrell, WB Matlock, Millennium, and Boomer, which are grown in geographical entities including North Dakota.

Exemplary *Triticum* cultivars provided herein include Yellowstone, Genou, CDC Falcon, Rampart, Ledger, Jerry, AP503 CL2, Hawken, Norris, Pryor, Jagalene, Carter, Morgan, Decade, WB Quake, Tiber, Willow Creek, Radiant, Neeley, Vanguard, Promontory, Overland, and Redwin, which are grown in geographical entities including Montana.

Exemplary *Triticum* cultivars provided herein include Duster, Endurance, Jagger, Fuller, OK Bullet, Jackpot, Everest, Billings, TAM 112, TAM 111, Big Max, Overley, Doans, Armour, Santa Fe, Garrison, Deliver, TAM 110, CJ, 2157, Custer, 2137, Scout, Centerfield, Triumph varieties, Dumas, TAM 401, Gallagher, Cutter, T-158, Ike, WB Hitch, Greer, AP 503 CL2, Ruby Lee, Pioneer 2548, Pioneer 2571, and Coker 762, which are grown in geographical entities including Oklahoma.

Exemplary *Triticum* cultivars provided herein include UI Stone, Diva, Petit, Jubilee, Louise, Alturas, Whit, Babe, Cataldo, Alpowa, BrundageCF, Brundage96, Bitterroot, Kaseberg, Amber, Bruneau, AP Legacy, Salute, Ladd, Junction, ORCF101, Mary, Masami, SY Ovation, Skiles, Rod, WB523, Legion, Eltan, WB528, Stephens, Otto, ORCF103, Rosalyn, Madsen, AP Badger, LCS Artdeco, ORCF102, Lambert, Goetze, WB456, WB1020M, AP700CL, Xerpha, Tubbs06, WB1066CL, Eddy, Finley, Juniper, Whetstone, Sprinter1, Paladin, DW, Buchanan, Farnum, Northwest 553, Peregrine, Rimrock, Declo, Esperia, Boundary, Bauermeister, Residence, Symphony, and Estica, which are grown in geographical entities including Washington state.

Exemplary *Triticum* cultivars provided herein include Wesley, Overland, Expedition, Clearfield, Smoky Hill, Arapahoe, Lyman, Hawken, Millennium, Jagalene, CDC Falcon, Alliance, Nekota, Briggs, RB07, Brick, Faller, Howard, Select, Traverse, Steele ND, Forge, Barlow, Butte86/Butte, Granger, Brennan, which are grown in geographical entities including South Dakota.

Barley

Exemplary barley cultivars provided herein include Azure, Beacon, Bere, Betzes, Bowman, Celebration, Centennial, Compana, Conlon, Diamant, Dickson, Drummond, Excel, Foster, Glenn, Golden Promise, Hazen, Highland barley, Kindred, Kindred L, Larker, Logan, Lux, Manchurian, Manscheuri, Mansury, Maris Otter, Morex, Nordal, Nordic, Optic, Park, Plumage Archer, Pearl, Pinnacle, Proctor, Pioneer, Rawson, Robust, Sioux, Stark, Tradition, Traill, Tregal, Trophy, Windich, and Yagan, which are grown throughout the world.

Exemplary barley cultivars provided herein include Tradition, Lacey, Robust, Celebration, Conlon, Pinnacle, Haybet, Legacy, Stellar-D, Innovation, Hays, Quest, Bowman, and Logan, which are grown in geographical entities including North Dakota.

Exemplary barley cultivars provided herein include AC METCALFE, HARRINGTON, CONRAD (B5057), LEGACY (B2978), MORAVIAN 69 (C69), MERIT (B4947), TRADITION (B2482), MORAVIAN 83 (C83), and CHARLES, which are grown in geographical entities including Idaho.

Exemplary barley cultivars provided herein include Harrington, Haybet, B 1202, Moravian, Baronesse, Hector, Bowman, Westford, B Merit, Gallatin, Horsford, Lewis, Stark, Piroline, Valier, B 2601, Legacy, Menuet, Robust, Chinook, and Clark, which are grown in geographical entities including Montana.

Exemplary barley cultivars provided herein include Champion, Bob, Baronesse, Radiant, Haybet, Belford, Camelot, BG, Camas, Gallatin, Copeland, AC Metcalfe, and Harrington, which are grown in geographical entities including Washington state.

Exemplary barley cultivars provided herein include Moravian 69, C-115, C-128, Scarlett, Baronesse, Hays, and Steptoe, which are grown in geographical entities including Colorado.

Transgenic Plants

The methods described herein also can be used with transgenic plants containing one or more exogenous transgenes, for example, to yield additional trait benefits (e.g., insect resistance, herbicide resistance, or modified fatty acid profile) to the benefits conferred by the presently described endophytic microbes. Therefore, in one embodiment, a seed or seedling of a transgenic maize, wheat, rice, barley, or soybean plant can be contacted with an endophytic microbe. Non-limiting examples of exogenous transgenes that can be present in a transgenic seed, seedling, or plant, include a nucleic acid sequence encoding a plant β-1,3-glucanase, a *Bacillus thuringiensis* (Bt) A endotoxin, Cry1Ac delta-endotoxin (e.g., Cry1Ac delta-endotoxin from *Bacillus thuringiensis* subsp. Kurstaki strain HD73), a Cry1F delta-endotoxin (e.g., Cry1F delta-endotoxin from *Bacillus thuringiensis* var. *aizawai*), a cp4 5-enolpyruvylshikimate-3-phosphate synthase (EPSPS), a fatty acid desaturase such as gm-fad2-1, a beta-lactamase (e.g., *E. coli* beta-lactamase), a beta-D-glucuronidase (GUS) enzyme, a phosphinothricin N-acetyltransferase (PAT) enzyme (e.g., *Streptomyces viridochromogenes* or *Streptomyces hygroscopicus* PAT enzyme), a modified acetohydroxyacid synthase large subunit (e.g., modified *Arabidopsis thaliana* acetohydroxyacid synthase large subunit), an aryloxyalkanoate di-oxygenase 12 (AAD-12) protein (e.g., *Delftia acidovorans* AAD-12 protein), a double mutant version of 5-EPSPS enzyme (e.g., double mutant version of *Zea mays* 5-EPSPS), an enzyme from *Agrobacterium tumefaciens* strain CP4), a modified acetolactate synthase (ALS) enzyme, glyphosate N-acetyltransferase enzyme (e.g., *Bacillus licheniformis* glyphosate N-acetyltransferase enzyme), hppdPF W336 (modified p-hydroxyphenylpyruvate dioxygenase (hppd) enzyme from *Pseudomonas fluorescens* strain A32), bbx32 (e.g., *Arabidopsis thaliana* bbx32), dicamba mono-oxygenase enzyme (e.g., dicamba mono-oxygenase enzyme from *Stenotrophomonas maltophilia* strain DI-6), cry1A.105 protein (Cry1A.105 protein including the Cry1Ab, Cry1F, and Cry1Ac proteins from *Bacilus thuringiensis* subsp. *kumamotoensis*), Cry2Ab delta-endotoxin (e.g., Cry2Ab delta-endotoxin from *Bacillus thuringiensis* subsp. *kumamotoensis*), a delta-6-desaturase protein (e.g., *Primula juliae* delta-6-desaturase protein), a delta-15-desaturase protein (e.g., *Neurospora crassa* delta-15-desaturase protein), or a p-hydroxyphenylpyruvate dioxygenase (e.g., *Avena sativa* p-hydroxyphenylpyruvate dioxygenase).

Non-limiting examples of exogenous (heterologous) nucleic acids that can be introduced into a plant cell, a plant seed, or a plant seedling and methods of how to introduce exogenous (heterologous) nucleic acid sequences into a plant cell, a plant seed, or a plant seedling to generate a transgenic plant are well-known in the art. See, e.g., U.S. Pat. No. 8,822,762; U.S. Pat. No. 8,822,761; U.S. Pat. No. 8,822,666; U.S. Pat. No. 8,819,991; U.S. Pat. No. 8,816,152; U.S. Pat. No. 8,809,636; U.S. Pat. No. 8,809,630; U.S. Pat. No. 8,809,628; U.S. Pat. No. 8,809,625; U.S. Pat. No. 8,809,059; U.S. Pat. No. 8,802,934; U.S. Pat. No. 8,802,933; U.S. Pat. No. 8,802,927; U.S. Pat. No. 8,796,505; U.S. Pat. No. 8,796,503; U.S. Pat. No. 8,795,701; U.S. Pat. No. 8,791,326; U.S. Pat. No. RE 45,048; U.S. Pat. No. 8,785,728; U.S. Pat. No. 8,779,242; U.S. Pat. No. 8,779,242; U.S. Pat. No. 8,779,239; U.S. Pat. No. 8,772,577; U.S. Pat. No. 8,772,466; U.S. Pat. No. 8,766,051; U.S. Pat. No. 8,759,619; U.S. Pat. No. 8,754,289; U.S. Pat. No. 8,754,011; U.S. Pat. No. 8,748,696; U.S. Pat. No. 8,735,657; U.S. Pat. No. 8,735,560; U.S. Pat. No. 8,716,554; U.S. Pat. No. 8,610,300; U.S. Pat. No. 8,692,071; U.S. Pat. No. 8,692,070; U.S. Pat. No. 8,692,066; U.S. Pat. No. 8,692,064; U.S. Pat. No. 8,692,054; U.S. Pat. No. 8,686,124; U.S. Pat. No. 8,674,176; U.S. Pat. No. 8,658,858; U.S. Pat. No. 8,653,328; U.S. Pat. No. 8,614,368; U.S. Pat. No. 8,609,937; U.S. Pat. No. 8,586,832; U.S. Pat. No. 8,575,425; U.S. Pat. No. 8,563,808; U.S. Pat. No. 8,541,653; U.S. Pat. No. 8,541,650; U.S. Pat. No. 8,513,493; U.S. Pat. No. 8,513,488; U.S. Pat. No. 8,502,026; U.S. Pat. No. 8,410,336; U.S. Pat. No. 8,404,933; U.S. Pat. No. 8,334,431; and U.S. Pat. No. 8,324,455; and U.S. Pat. No. 8,293,981; U.S. Pat. No. 8,273,952; and U.S. Pat. No. 8,222,486. Methods of introducing a heterologous nucleic acid into a plant cell can include, for example, the use of biolostics, *Agrobacterium*, electroporation, or gene knockouts.

Methods of Using Seed Bacterial Endophytes

As described herein, purified bacterial populations that include one or more seed bacterial endophytes and compositions containing the same (e.g., agricultural formulations, preparation, or treatments) can be used to confer beneficial traits to a host plant including, for example, one or more of the following: increased root biomass, increased root length, increased height, increased shoot length, increased leaf number, increased water use efficiency, increased overall biomass, increase yield (or grain yield), increased photosynthesis rate, increased tolerance to drought, increased heat tolerance, increased salt tolerance, increased resistance to nematode stress, increased resistance to a fungal pathogen, increased resistance to a bacterial pathogen, increased resistance to a viral pathogen, a detectable modulation in the level of a metabolite, and a detectable modulation in the proteome relative to a reference plant. For example, in some embodiments, a purified bacterial population that includes a seed bacterial endophyte can improve two or more such beneficial traits, e.g., water use efficiency and increased tolerance to drought. For example, in some embodiments, a purified bacterial population that includes a seed bacterial endophyte can improve three or more such beneficit traits, e.g., water use efficiency, increased tolerance to drought, and a detectable modulation in the proteome. Such traits can be heritable by progeny of the agricultural plant to which the seed bacterial endophyte was applied or by progeny of the agricultural plant that was grown from the seed associated with the seed bacterial endophyte, In some cases, the seed bacterial endophyte may produce one or more compounds and/or have one or more activities that are beneficial to the plant, e.g., one or more of the following: production of a metabolite, production of a phytohormone such as auxin, production of acetoin, production of an antimicrobial compound, production of a siderophore, production of a cellulase, production of a pectinase, production of a chitinase, production of a xylanase, nitrogen fixation, or mineral phosphate solubilization. For example, a seed bacterial endophyte can produce a phytohormone selected from the group consisting of an auxin, a cytokinin, a gibberellin, ethylene, a brassinosteroid, and abscisic acid. In one particular embodiment, the seed bacterial endophyte produces auxin (e.g., indole-3-acetic acid (IAA)) or induces an agricultural plant to do so. Production of auxin can be assayed as described herein. Many of the microbes described herein are capable of producing the plant hormone auxin indole-3-acetic acid (IAA) when grown in culture. Auxin plays a key role in altering the physiology of the plant, including the extent of root growth. Therefore, in another embodiment, the bacterial endophytic population is disposed on the surface or within a tissue of the seed or seedling in an amount effective to detectably induce production of auxin in the agricultural plant. For example, the increase in auxin production can be at least 10%, for example, at least 20%, at least 30%, at least 40%, at least 50%, at least 60%, at least 75%, at least 100%, or more, when compared with a reference agricultural plant. In one embodiment, the increased auxin production can be detected in a tissue type selected from the group consisting of the root, shoot, leaves, and flowers.

In some embodiments, the seed bacterial endophyte can produce a compound with antimicrobial properties or induce an agricultural plant to do so For example, the compound can have antibacterial properties, as determined by the growth assays provided herein. In one embodiment, the compound with antibacterial properties shows bacteriostatic or bactericidal activity against *E. coli* and/or *Bacillus* sp. In another embodiment, the seed bacterial endophyte produces a compound with antifungal properties, for example, fungicidal or fungistatic activity against *S. cerevisiae* and/or *Rhizoctonia*.

In some embodiments, the seed bacterial endophyte is capable of nitrogen fixation, and is thus capable of producing ammonium from atmospheric nitrogen. The ability of bacteria to fix nitrogen can be confirmed by testing for growth of the bacteria in nitrogen-free growth media, for example, LGI media, as described herein.

In some embodiments, the seed bacterial endophyte can produce a compound which increases the solubility of mineral phosphate in the medium, i.e., mineral phosphate solubilization, or induce an agricultural plant to do so. Mineral phosphate solubilization can be assessed, for example, using the growth assays described herein. In one embodiment, the seed bacterial endophyte produces a compound which allows the bacterium to grow in growth media containing $Ca_3HPO_4$ as the sole phosphate source.

In some embodiments, the seed bacterial endophyte can produce a siderophore or induce an agricultural plant to do so. Siderophores are small high-affinity iron chelating agents secreted by microorganisms that increase the bioavailability of iron. Siderophore production by a bacterial endophyte can be detected, for example, using the methods described herein, as well as elsewhere (Perez-Miranda et al., 2007, J Microbiol Methods. 70:127-31, incorporated herein by reference in its entirety).

In some embodiments, the seed bacterial endophyte can produce acetoin or induce an agricultural plant to do so. Acetoin (also known as 3-hydroxybutanone) can be detected using the method described herein. See also, Phalip et al., 1994, J Basic Microbiol 34(4): 277-280, incorporated herein by reference in its entirety.

In some embodiments, the seed bacterial endophyte can produce a hydrolytic enzyme or induce an agricultural plant to do so. For example, in one embodiment, a bacterial endophyte can produce a hydrolytic enzyme selected from the group consisting of a cellulase, a pectinase, a chitinase and a xylanase. Hydrolytic enzymes can be detected using the methods described herein (see also, cellulase: Quadt-Hallmann et al., (1997) Can. J. Microbiol., 43: 577-582; pectinase: Soares et al. (1999). Revista de Microbiolgia 30(4): 299-303; chitinase: Li et al., (2004) Mycologia 96: 526-536; and xylanase: Suto et al., (2002) J Biosci Bioeng. 93:88-90, each of which is incorporated by reference in its entirety).

In some embodiment, purified bacterial populations contain synergistic endophytic populations, e.g., synergistic seed bacterial endophytes. As used herein, synergistic endophytic populations refer to two or more endophyte populations that produce one or more effects (e.g., two or more or three or more effects) that are greater than the sum of their individual effects. For example, in some embodiments, a purified bacterial population contains two or more different seed bacterial endophytes that are capable of synergistically increasing at least one of e.g., production of a phytohormone such as auxin, production of acetoin, production of an antimicrobial compound, production of a siderophore, production of a cellulase, production of a pectinase, production of a chitinase, production of a xylanase, nitrogen fixation, or mineral phosphate solubilization in an agricultural plant (e.g, an agricultural grass plant or a *Glycine* plant). Synergistically increasing one or more of such properties can increase a beneficial trait in an agricultural plant, such as an increase in drought tolerance.

In some embodiments, a purified bacterial population containing one or more seed bacterial endophytes can increase one or more properties such as production of a phytohormone such as auxin, production of acetoin, production of an antimicrobial compound, production of a siderophore, production of a cellulase, production of a pectinase, production of a chitinase, production of a xylanase, or mineral phosphate solubilization in an agricultural grass plant, without increasing nitrogen fixation in the agricultural grass plant.

In some embodiments, metabolites in grass plants can be modulated by making synthetic combinations of purified bacterial populations containing endophytic microbes such as seed bacterial endophytes and a seed or seedling of an agricultural grass plant. For example, a bacterial endophyte described herein can cause a detectable modulation (e.g., an increase or decrease) in the level of various metabolites, e.g., indole-3-carboxylic acid, trans-zeatin, abscisic acid, phaseic acid, indole-3-acetic acid, indole-3-butyric acid, indole-3-acrylic acid, jasmonic acid, jasmonic acid methyl ester, dihydrophaseic acid, gibberellin A3, salicylic acid, upon colonization of a grass plant.

In some embodiments, the endophytic microbe modulates the level of the metabolite directly (e.g., the microbe itself produces the metabolite, resulting in an overall increase in the level of the metabolite found in the plant). In other cases, the agricultural plant (e.g., a grass plant or a *Glycine* plant), as a result of the association with the endophytic microbe (e.g., a seed bacterial endophyte), exhibits a modulated level of the metabolite (e.g., the plant reduces the expression of a biosynthetic enzyme responsible for production of the metabolite as a result of the microbe inoculation). In still other cases, the modulation in the level of the metabolite is a consequence of the activity of both the microbe and the plant (e.g., the plant produces increased amounts of the metabolite when compared with a reference agricultural plant, and the endophytic microbe also produces the metabolite). Therefore, as used herein, a modulation in the level of a metabolite can be an alteration in the metabolite level through the actions of the microbe and/or the inoculated plant.

The levels of a metabolite can be measured in an agricultural plant, and compared with the levels of the metabolite in a reference agricultural plant, and grown under the same conditions as the inoculated plant. The uninoculated plant that is used as a reference agricultural plant is a plant which has not been applied with a formulation with the endophytic microbe (e.g., a formulation including a population of purified bacterial endophytes). The uninoculated plant used as the reference agricultural plant is generally the same species and cultivar as, and is isogenic to, the inoculated plant.

The metabolite whose levels are modulated (e.g., increased or decreased) in the endophyte-associated plant may serve as a primary nutrient (i.e., it provides nutrition for the humans and/or animals who consume the plant, plant tissue, or the commodity plant product derived therefrom, including, but not limited to, a sugar, a starch, a carbohydrate, a protein, an oil, a fatty acid, or a vitamin). The metabolite can be a compound that is important for plant growth, development or homeostasis (for example, a phytohormone such as an auxin, cytokinin, gibberellin, a brassinosteroid, ethylene, or abscisic acid, a signaling molecule, or an antioxidant). In other embodiments, the metabolite can have other functions. For example, in one embodiment, a metabolite can have bacteriostatic, bactericidal, fungistatic, fungicidal or antiviral properties. In other embodiments, the metabolite can have insect-repelling, insecticidal, nematode-repelling, or nematicidal properties. In still other embodiments, the metabolite can serve a role in protecting the plant from stresses, may help improve plant vigor or the general health of the plant. In yet another embodiment, the metabolite can be a useful compound for industrial production. For example, the metabolite may itself be a useful compound that is extracted for industrial use, or serve as an intermediate for the synthesis of other compounds used in industry. A level of a metabolite can be increased by 1%, for example, at least 10%, for example, at least 20%, at least 30%, at least 40%, at least 50%, at least 75%, at least 100%, at least 150%, at least 200%, at least 300% or more, when compared with a reference agricultural plant. In a particular embodiment, the level of the metabolite is increased within the agricultural plant or a portion thereof such that it is present at a concentration of at least 0.1 µg/g dry weight, for example, at least 0.3 µg/g dry weight, 1.0 µg/g dry weight, 3.0 µg/g dry weight, 10 µg/g dry weight, 30 µg/g dry weight, 100 µg/g dry weight, 300 µg/g dry weight, 1 mg/g dry weight, 3 mg/g dry weight, 10 mg/g dry weight, 30 mg/g dry weight, 100 mg/g dry weight or more, of the plant or portion thereof.

Likewise, the modulation can be a decrease in the level of a metabolite. The reduction can be in a metabolite affecting the taste of a plant or a commodity plant product derived from a plant (for example, a bitter tasting compound), or in a metabolite which makes a plant or the resulting commodity plant product otherwise less valuable (for example, reduction of oxalate content in certain plants, or compounds which are deleterious to human and/or animal health). The metabolite whose level is to be reduced can be a compound which affects quality of a commodity plant product (e.g., reduction of lignin levels). The level of metabolite in the agricultural grass plant or portion thereof can be, for example, decreased by at least 1%, for example, at least 10%, at least 20%, at least 30%, at least 40%, at least 50%, at least 75%, at least 80%, at least 85%, at least 90%, at least 95%, at least 97%, at least 99% or more, when compared with a reference agricultural plant in a reference environment.

In some embodiments, the seed bacterial endophyte is capable of generating a bacterial network in the agricultural grass plant or surrounding environment of the plant, which network is capable of causing a detectable modulation in the level of a metabolite in the host plant.

In a particular embodiment, the metabolite can serve as a signaling or regulatory molecule. The signaling pathway can be associated with a response to a stress, for example, one of the stress conditions selected from the group consisting of drought stress, salt stress, heat stress, cold stress, low nutrient stress, nematode stress, insect herbivory stress, fungal pathogen stress, bacterial pathogen stress, and viral pathogen stress.

The inoculated agricultural plant is grown under conditions such that the level of one or more metabolites is modulated in the plant, wherein the modulation is indicative of increased resistance to a stress selected from the group consisting of drought stress, salt stress, heat stress, cold stress, low nutrient stress, nematode stress, insect herbivory stress, fungal pathogen stress, bacterial pathogen stress, and viral pathogen stress. The increased resistance can be measured at about 10 minutes after applying the stress, for example about 20 minutes, 30 minutes, about 45 minutes, about 1 hour, about 2 hours, about 4 hours, about 8 hours, about 12 hours, about 16 hours, about 20 hours, about 24 hours, about 36 hours, about 48 hours, about 72 hours, about 96 hours, about 120 hours, or about a week after applying the stress.

The metabolites or other compounds described herein can be detected using any suitable method including, but not limited to gel electrophoresis, liquid and gas phase chromatography, either alone or coupled to mass spectrometry (See, for example, the Examples sections below), NMR (See e.g., U.S. patent publication 20070055456, which is incorporated herein by reference in its entirety), immunoassays (enzyme-linked immunosorbent assays (ELISA)), chemical assays, spectroscopy and the like. In some embodiments, commercial systems for chromatography and NMR analysis are utilized.

In other embodiments, metabolites or other compounds are detected using optical imaging techniques such as magnetic resonance spectroscopy (MRS), magnetic resonance imaging (MRI), CAT scans, ultra sound, MS-based tissue imaging or X-ray detection methods (e.g., energy dispersive x-ray fluorescence detection).

Any suitable method may be used to analyze the biological sample (e.g., seed or plant tissue) in order to determine the presence, absence or level(s) of the one or more metabolites or other compounds in the sample. Suitable methods include chromatography (e.g., HPLC, gas chromatography, liquid chromatography), mass spectrometry (e.g., MS, MS-MS), LC-MS, enzyme-linked immunosorbent assay (ELISA), antibody linkage, other immunochemical techniques, biochemical or enzymatic reactions or assays, and combinations thereof. The levels of one or more of the recited metabolites or compounds may be determined in the methods of the present invention. For example, the level(s) of one metabolites or compounds, two or more metabolites, three or more metabolites, four or more metabolites, five or more metabolites, six or more metabolites, seven or more metabolites, eight or more metabolites, nine or more metabolites, ten or more metabolites, or compounds etc., including a combination of some or all of the metabolites or compounds including, but not limited to those disclosed herein may be determined and used in such methods.

As shown in the Examples and otherwise herein, endophyte-inoculated plants display increased thermal tolerance, herbicide tolerance, drought resistance, insect resistance, fungus resistance, virus resistance, bacteria resistance, male sterility, cold tolerance, salt tolerance, increased yield, enhanced nutrient use efficiency, increased nitrogen use efficiency, increased protein content, increased fermentable carbohydrate content, reduced lignin content, increased antioxidant content, enhanced water use efficiency, increased vigor, increased germination efficiency, earlier or increased flowering, increased biomass, altered root-to-shoot biomass ratio, enhanced soil water retention, or a combination thereof. Therefore, in one embodiment, the bacterial endophytic population is disposed on the surface or within a tissue of the seed or seedling in an amount effective to increase the biomass of the plant, or a part or tissue of the plant grown from the seed or seedling. The increased biomass is useful in the production of commodity products derived from the plant. Such commodity products include an animal feed, a fish fodder, a cereal product, a protein product, and oil product, a processed human-food product, a sugar or an alcohol. Such products may be a fermentation product or a fermentable product, one such exemplary product is a biofuel. The increase in biomass can occur in a part of the plant (e.g., the root tissue, shoots, leaves, etc.), or can be an increase in overall biomass. Increased biomass production, such an increase meaning at least about 10%, 20%, 30%, 40%, 50%, 60%, 70%, 80%, 90%, 100%, or greater than 100% when compared with a reference agricultural plant. Such increase in overall biomass can be under relatively stress-free conditions. In other cases, the increase in biomass can be in plants grown under any number of abiotic or biotic stresses, including drought stress, salt stress, heat stress, cold stress, low nutrient stress, nematode stress, insect herbivory stress, fungal pathogen stress, bacterial pathogen stress, and viral pathogen stress. In one particular embodiment, the bacterial endophytic population is disposed in an amount effective to increase root biomass by at least 10%, for example, at least 20%, at least 30%, at least 40%, at least 50%, at least 60%, at least 75%, at least 100%, or more, when compared with a reference agricultural plant.

In another embodiment, the bacterial endophytic population is disposed on the surface or within a tissue of the seed or seedling in an amount effective to increase the rate of seed germination when compared with a reference agricultural plant. For example, the increase in seed germination can be at least 10%, for example, at least 20%, at least 30%, at least 40%, at least 50%, at least 60%, at least 75%, at least 100%, or more, when compared with a reference agricultural plant.

In other cases, the endophytic microbe is disposed on the seed or seedling in an amount effective to increase the average biomass of the fruit or cob from the resulting plant by at least 10%, for example, at least 20%, at least 30%, at least 40%, at least 50%, at least 75%, at least 100% or more, when compared with a reference agricultural plant.

As highlighted in the Examples section, plants inoculated with a bacterial endophytic population also show an increase in overall plant height. Therefore, in one embodiment, the present invention provides for a seed including a bacterial endophytic population which is disposed on the surface or within a tissue of the seed or seedling in an amount effective to increase the height of the plant. For example, the bacterial endophytic population is disposed in an amount effective to result in an increase in height of the agricultural plant such that is at least 10% greater, for example, at least 20% greater, at least 30% greater, at least 40% greater, at least 50% greater, at least 60% greater, at least 70% greater, at least 80% greater, at least 90% greater, at least 100% greater, at least 125% greater, at least 150% greater or more, when compared with a reference agricultural plant. Such an increase in height can be under relatively stress-free conditions. In other cases, the increase in height can be in plants grown under any number of abiotic or biotic stresses, including drought stress, salt stress, heat stress, cold stress, low nutrient stress, nematode stress, insect herbivory stress, fungal pathogen stress, bacterial pathogen stress, or viral pathogen stress.

The host plants inoculated with the bacterial endophytic population also show dramatic improvements in their ability to utilize water more efficiently. Water use efficiency is a parameter often correlated with drought tolerance. Water use efficiency (WUE) is a parameter often correlated with drought tolerance, and is the CO2 assimilation rate per water transpired by the plant. An increase in biomass at low water availability may be due to relatively improved efficiency of growth or reduced water consumption. In selecting traits for improving crops, a decrease in water use, without a change in growth would have particular merit in an irrigated agricultural system where the water input costs were high. An increase in growth without a corresponding jump in water use would have applicability to all agricultural systems. In many agricultural systems where water supply is not limiting, an increase in growth, even if it came at the expense of an increase in water use also increases yield.

When soil water is depleted or if water is not available during periods of drought, crop yields are restricted. Plant water deficit develops if transpiration from leaves exceeds the supply of water from the roots. The available water supply is related to the amount of water held in the soil and the ability of the plant to reach that water with its root system. Transpiration of water from leaves is linked to the fixation of carbon dioxide by photosynthesis through the stomata. The two processes are positively correlated so that high carbon dioxide influx through photosynthesis is closely linked to water loss by transpiration. As water transpires from the leaf, leaf water potential is reduced and the stomata tend to close in a hydraulic process limiting the amount of photosynthesis. Since crop yield is dependent on the fixation of carbon dioxide in photosynthesis, water uptake and transpiration are contributing factors to crop yield. Plants which are able to use less water to fix the same amount of carbon dioxide or which are able to function normally at a lower water potential have the potential to conduct more photosynthesis and thereby to produce more biomass and economic yield in many agricultural systems. An increased water use efficiency of the plant relates in some cases to an increased fruit/kernel size or number.

Therefore, in one embodiment, the plants described herein exhibit an increased water use efficiency (WUE) when compared with a reference agricultural plant grown under the same conditions. For example, the plants grown from the seeds including the bacterial endophytic population can have at least 5% higher WUE, for example, at least 10% higher, at least 20% higher, at least 30% higher, at least 40% higher, at least 50% higher, at least 60% higher, at least 70% higher, at least 80% higher, at least 90% higher, at least 100% higher WUE than a reference agricultural plant grown under the same conditions. Such an increase in WUE can occur under conditions without water deficit, or under conditions of water deficit, for example, when the soil water content is less than or equal to 60% of water saturated soil, for example, less than or equal to 50%, less than or equal to 40%, less than or equal to 30%, less than or equal to 20%, less than or equal to 10% of water saturated soil on a weight basis.

In a related embodiment, the plant including the bacterial endophyte can have at least 10% higher relative water content (RWC), for example, at least 20% higher, at least 30% higher, at least 40% higher, at least 50% higher, at least 60% higher, at least 70% higher, at least 80% higher, at least 90% higher, at least 100% higher RWC than a reference agricultural plant grown under the same conditions.

Synthetic Combinations and Methods of Making

As shown in the Examples section below, the bacterial endophytic populations described herein are capable of colonizing a host plant. Successful colonization can be confirmed by detecting the presence of the bacterial population within the plant. For example, after applying the bacteria to the seeds, high titers of the bacteria can be detected in the roots and shoots of the plants that germinate from the seeds. In addition, significant quantities of the bacteria can be detected in the rhizosphere of the plants. Detecting the presence of the endophytic microbe inside the plant can be accomplished by measuring the viability of the microbe after surface sterilization of the seed or the plant: endophytic colonization results in an internal localization of the microbe, rendering it resistant to conditions of surface sterilization. The presence and quantity of the microbe can also be established using other means known in the art, for example, immunofluorescence microscopy using microbe specific antibodies, or fluorescence in situ hybridization (see, for example, Amann et al. (2001) Current Opinion in Biotechnology 12:231-236, incorporated herein by reference in its entirety). Alternatively, specific nucleic acid probes recognizing conserved sequences from the endophytic bacterium can be employed to amplify a region, for example by quantitative PCR, and correlated to CFUs by means of a standard curve.

In another embodiment, the endophytic microbe is disposed, for example, on the surface of a seed of an agricultural plant (e.g., a grass plant or a *Glycine* plant), in an amount effective to be detectable in the mature agricultural plant. In one embodiment, the endophytic microbe is disposed in an amount effective to be detectable in an amount of at least about 100 CFU, at least about 200 CFU, at least about 300 CFU, at least about 500 CFU, at least about 1,000 CFU, at least about 3,000 CFU, at least about 10,000 CFU, at least about 30,000 CFU, at least about 100,000 CFU or more in the mature agricultural plant.

In some cases, the endophytic microbe is capable of colonizing particular tissue types of the plant. In one embodiment, the endophytic microbe is disposed on the seed or seedling in an amount effective to be detectable within a target tissue of the mature agricultural plant selected from a fruit, a seed, a leaf, or a root, or portion thereof. For example, the endophytic microbe can be detected in an amount of at least about 100 CFU, at least about 200 CFU, at least about 300 CFU, at least about 500 CFU, at least about 1,000 CFU, at least about 3,000 CFU, at least about 10,000 CFU, at least about 30,000 CFU, at least about 100,000 CFU or more, in the target tissue of the mature agricultural plant.

Endophytes Compatible with Agrichemicals.

In certain embodiments, the endophyte is selected on the basis of its compatibility with commonly used agrichemicals. As mentioned earlier, plants, particularly agricultural plants, can be treated with a vast array of agrichemicals, including fungicides, biocides (anti-bacterial agents), herbicides, insecticides, nematicides, rodenticides, fertilizers, and other agents.

In some cases, it can be important for the endophyte to be compatible with agrichemicals, particularly those with fungicidal or antibacterial properties, in order to persist in the plant although, as mentioned earlier, there are many such fungicidal or antibacterial agents that do not penetrate the plant, at least at a concentration sufficient to interfere with the endophyte. Therefore, where a systemic fungicide or antibacterial agent is used in the plant, compatibility of the endophyte to be inoculated with such agents will be an important criterion.

In one embodiment, natural isolates of endophytes which are compatible with agrichemicals can be used to inoculate the plants according to the methods described herein. For example, fungal endophytes which are compatible with agriculturally employed fungicides can be isolated by plating a culture of the endophytes on a petri dish containing an effective concentration of the fungicide, and isolating colonies of the endophyte that are compatible with the fungicide. In another embodiment, an endophyte that is compatible with a fungicide is used for the methods described herein. For example, the endophyte can be compatible with at least one of the fungicides selected from the group consisting of: 2-(thiocyanatomethylthio)-benzothiazole, 2-phenylphenol, 8-hydroxyquinoline sulfate, ametoctradin, amisulbrom, antimycin, *Ampelomyces quisqualis*, azaconazole, azoxystrobin, *Bacillus subtilis*, benalaxyl, benomyl, benthiavalicarb-isopropyl, benzylaminobenzene-sulfonate (BABS) salt, bicarbonates, biphenyl, bismerthiazol, bitertanol, bixafen, blasticidin-S, borax, Bordeaux mixture, boscalid, bromuconazole, bupirimate, calcium polysulfide, captafol, captan, carbendazim, carboxin, carpropamid, carvone, chloroneb, chlorothalonil, chlozolinate, *Coniothyrium minitans*, copper hydroxide, copper octanoate, copper oxychloride, copper sulfate, copper sulfate (tribasic), cuprous oxide, cyazofamid, cyflufenamid, cymoxanil, cyproconazole, cyprodinil, dazomet, debacarb, diammonium ethylenebis-(dithiocarbamate), dichlofluanid, dichlorophen, diclocymet, diclomezine, dichloran, diethofencarb, difenoconazole, difenzoquat ion, diflumetorim, dimethomorph, dimoxystrobin, diniconazole, diniconazole-M, dinobuton, dinocap, diphenylamine, dithianon, dodemorph, dodemorph acetate, dodine, dodine free base, edifenphos, enestrobin, epoxiconazole, ethaboxam, ethoxyquin, etridiazole, famoxadone, fenamidone, fenarimol, fenbuconazole, fenfuram, fenhexamid, fenoxanil, fenpiclonil, fenpropidin, fenpropimorph, fentin, fentin acetate, fentin hydroxide, ferbam, ferimzone, fluazinam, fludioxonil, flumorph, fluopicolide, fluopyram, fluoroimide, fluoxastrobin, fluquinconazole, flusilazole, flusulfamide, flutianil, flutolanil, flutriafol, fluxapyroxad, folpet, formaldehyde, fosetyl, fosetyl-aluminium, fuberidazole, furalaxyl, furametpyr, guazatine, guazatine acetates, GY-81, hexachlorobenzene, hexaconazole, hymexazol, imazalil, imazalil sulfate, imibenconazole, iminoctadine, iminoctadine triacetate, iminoctadine tris(albesilate), ipconazole, iprobenfos, iprodione, iprovalicarb, isoprothiolane, isopyrazam, isotianil, kasugamycin, kasugamycin hydrochloride hydrate, kresoxim-methyl, mancopper, mancozeb, mandipropamid, maneb, mepanipyrim, mepronil, mercuric chloride, mercuric oxide, mercurous chloride, metalaxyl, mefenoxam, metalaxyl-M, metam, metam-ammonium, metam-potassium, metam-sodium, metconazole, methasulfocarb, methyl iodide, methyl isothiocyanate, metiram, metominostrobin, metrafenone, mildiomycin, myclobutanil, nabam, nitrothal-isopropyl, nuarimol, octhilinone, ofurace, oleic acid (fatty acids), orysastrobin, oxadixyl, oxine-copper, oxpoconazole fumarate, oxycarboxin, pefurazoate, penconazole, pencycuron, penflufen, pentachlorophenol, pentachlorophenyl laurate, penthiopyrad, phenylmercury acetate, phosphonic acid, phthalide, picoxystrobin, polyoxin B, polyoxins, polyoxorim, potassium bicarbonate, potassium hydroxyquinoline sulfate, probenazole, prochloraz, procymidone, propamocarb, propamocarb hydrochloride, propiconazole, propineb, proquinazid, prothioconazole, pyraclostrobin, pyrametostrobin, pyraoxystrobin, pyrazophos, pyribencarb, pyributicarb, pyrifenox, pyrimethanil, pyroquilon, quinoclamine, quinoxyfen, quintozene, *Reynoutria sachalinensis* extract, sedaxane, silthiofam, simeconazole, sodium 2-phenylphenoxide, sodium bicarbonate, sodium pentachlorophenoxide, spiroxamine, sulfur, SYP-Z071, SYP-Z048, tar oils, tebuconazole, tebufloquin, tecnazene, tetraconazole, thiabendazole, thifluzamide, thiophanate-methyl, thiram, tiadinil, tolclofos-methyl, tolylfluanid, triadimefon, triadimenol, triazoxide, tricyclazole, tridemorph, trifloxystrobin, triflumizole, triforine, triticonazole, validamycin, valifenalate, valiphenal, vinclozolin, zineb, ziram, zoxamide, *Candida oleophila*, *Fusarium oxysporum*, *Gliocladium* spp., *Phlebiopsis gigantea*, *Streptomyces griseoviridis*, *Trichoderma* spp., (RS)—N-(3,5-dichlorophenyl)-2-(methoxymethyl)-succinimide, 1,2-dichloropropane, 1,3-dichloro-1,1,3,3-tetrafluoroacetone hydrate, 1-chloro-2,4-dinitronaphthalene, 1-chloro-2-nitropropane, 2-(2-heptadecyl-2-imidazolin-1-yl)ethanol, 2,3-dihydro-5-phenyl-1,4-dithi-ine 1,1,4,4-tetraoxide, 2-methoxyethylmercury acetate, 2-methoxyethylmercury chloride, 2-methoxyethylmercury silicate, 3-(4-chlorophenyl)-5-methylrhodanine, 4-(2-nitroprop-1-enyl)phenyl thiocyanateme, ampropylfos, anilazine, azithiram, barium polysulfide, Bayer 32394, benodanil, benquinox, bentaluron, benzamacril; benzamacril-isobutyl, benzamorf, binapacryl, bis(methylmercury) sulfate, bis(tributyltin) oxide, buthiobate, cadmium calcium copper zinc chromate sulfate, carbamorph, CECA, chlobenthiazone, chloraniformethan, chlorfenazole, chlorquinox, climbazole, cyclafuramid, cypendazole, cyprofuram, decafentin, dichlone, dichlozoline, diclobutrazol, dimethirimol, dinocton, dinosulfon, dinoterbon, dipyrithione, ditalimfos, dodicin, drazoxolon, EBP, ESBP, etaconazole, etem, ethirim, fenaminosulf, fenapanil, fenitropan, 5-fluorocytosine and profungicides thereof, fluotrimazole, furcarbanil, furconazole, furconazole-cis, furmecyclox, furophanate, glyodine, griseofulvin, halacrinate, Hercules 3944, hexylthiofos, ICIA0858, isopamphos, isovaledione, mebenil, mecarbinzid, metazoxolon, methfuroxam, methylmercury dicyandiamide, metsulfovax, milneb, mucochloric anhydride, myclozolin, N-3,5-dichlorophenyl-succinimide, N-3-nitrophenylitaconimide, natamycin, N-ethylmercurio-4-toluenesulfonanilide, nickel bis(dimethyldithiocarbamate), OCH, phenylmercury dimethyldithiocarbamate, phenylmercury nitrate, phosdiphen, picolinamide UK-2A and derivatives thereof, prothiocarb; prothiocarb hydrochloride, pyracarbolid, pyridinitril, pyroxychlor, pyroxyfur, quinacetol; quinacetol sulfate, quinazamid, quinconazole, rabenzazole, salicylanilide, SSF-109, sultropen, tecoram, thiadifluor, thicyofen, thiochlorfenphim, thiophanate, thioquinox, tioxymid, triamiphos, triarimol, triazbutil, trichlamide, urbacid, XRD-563, and zarilamide, IK-1140.

In still another embodiment, an endophyte that is compatible with an antibacterial compound is used for the methods described herein. For example, the endophyte can be compatible with at least one of the antibiotics selected from the group consisting of:

Amikacin, Gentamicin, Kanamycin, Neomycin, Netilmicin, Tobramycin, Paromomycin, Spectinomycin, Geldanamycin, Herbimycin, Rifaximin, streptomycin, Loracarbef, Ertapenem, Doripenem, Imipenem/Cilastatin, Meropenem, Cefadroxil, Cefazolin, Cefalotin or Cefalothin, Cefalexin, Cefaclor, Cefamandole, Cefoxitin, Cefprozil, Cefuroxime, Cefixime, Cefdinir, Cefditoren, Cefoperazone, Cefotaxime, Cefpodoxime, Ceftazidime, Ceftibuten, Ceftizoxime, Ceftriaxone, Cefepime, Ceftaroline fosamil, Ceftobiprole, Teicoplanin, Vancomycin, Telavancin, Clindamycin, Lincomycin, Daptomycin, Azithromycin, Clarithromycin, Dirithromycin, Erythromycin, Roxithromycin, Troleandomycin, Telithromycin, Spiramycin, Aztreonam, Furazolidone, Nitrofurantoin, Linezolid, Posizolid, Radezolid, Torezolid, Amoxicillin, Ampicillin, Azlocillin, Carbenicillin, Cloxacillin, Dicloxacillin, Flucloxacillin, Mezlocillin, Methicillin, Nafcillin, Oxacillin, Penicillin G, Penicillin V, Piperacillin, Penicillin G, Temocillin, Ticarcillin, Amoxicillin/clavulanate, Ampicillin/sulbactam, Piperacillin/tazobactam, Ticarcillin/clavulanate, Bacitracin, Colistin, Polymyxin B, Ciprofloxacin, Enoxacin, Gatifloxacin, Levofloxacin, Lomefloxacin, Moxifloxacin, Nalidixic acid, Norfloxacin, Ofloxacin, Trovafloxacin, Grepafloxacin, Sparfloxacin, Temafloxacin, Mafenide, Sulfacetamide, Sulfadiazine, Silver sulfadiazine, Sulfadimethoxine, Sulfamethizole, Sulfamethoxazole, Sulfanilimide (archaic), Sulfasalazine, Sulfisoxazole, Trimethoprim-Sulfamethoxazole (Co-trimoxazole) (TMP-SMX), Sulfonamidochrysoidine (archaic), Demeclocycline, Doxycycline, Minocycline, Oxytetracycline, Tetracycline, Clofazimine, Dapsone, Capreomycin, Cycloserine, Ethambutol, Ethionamide, Isoniazid, Pyrazinamide, Rifampicin (Rifampin in US), Rifabutin, Rifapentine, Streptomycin, Arsphenamine, Chloramphenicol, Fosfomycin, Fusidic acid, Metronidazole, Mupirocin, Platensimycin, Quinupristin/Dalfopristin, Thiamphenicol, Tigecycline, Tinidazole, and Trimethoprim. Fungicide compatible endophytes can also be isolated by selection on liquid medium. The culture of endophytes can be plated on petri dishes without any forms of mutagenesis; alternatively, the endophytes can be mutagenized using any means known in the art. For example, microbial cultures can be exposed to UV light, gamma-irradiation, or chemical mutagens such as ethylmethanesulfonate (EMS) prior to selection on fungicide containing media. Finally, where the mechanism of action of a particular fungicide is known, the target gene can be specifically mutated (either by gene deletion, gene replacement, site-directed mutagenesis, etc.) to generate an endophyte that is resilient against that particular fungicide. It is noted that the above-described methods can be used to isolate fungi that are compatible with both fungistatic and fungicidal compounds.

It will also be appreciated by one skilled in the art that a plant may be exposed to multiple types of fungicides or antibacterial compounds, either simultaneously or in succession, for example at different stages of plant growth. Where the target plant is likely to be exposed to multiple fungicidal and/or antibacterial agents, an endophyte that is compatible with many or all of these agrichemicals can be used to inoculate the plant. An endophyte that is compatible with several fungicidal agents can be isolated, for example, by serial selection. An endophyte that is compatible with the first fungicidal agent is isolated as described above (with or without prior mutagenesis). A culture of the resulting endophyte can then be selected for the ability to grow on liquid or solid media containing the second antifungal compound (again, with or without prior mutagenesis). Colonies isolated from the second selection are then tested to confirm its compatibility to both antifungal compounds.

Likewise, bacterial endophytes that are compatible to biocides (including herbicides such as glyphosate or antibacterial compounds, whether bacteriostatic or bactericidal) that are agriculturally employed can be isolated using methods similar to those described for isolating fungicide compatible endophytes. In one embodiment, mutagenesis of the microbial population can be performed prior to selection with an antibacterial agent. In another embodiment, selection is performed on the microbial population without prior mutagenesis. In still another embodiment, serial selection is performed on an endophyte: the endophyte is first selected for compatibility to a first antibacterial agent. The isolated compatible endophyte is then cultured and selected for compatibility to the second antibacterial agent. Any colony thus isolated is tested for compatibility to each, or both antibacterial agents to confirm compatibility with these two agents.

Compatibility with an antimicrobial agent can be determined by a number of means known in the art, including the comparison of the minimal inhibitory concentration (MIC) of the unmodified and modified endophyte. Therefore, in one embodiment, the present invention discloses an isolated modified endophyte derived from an endophyte isolated from within a plant or tissue thereof, wherein the endophyte is modified such that it exhibits at least 3 fold greater, for example, at least 5 fold greater, at least 10 fold greater, at least 20 fold greater, at least 30 fold greater or more MIC to an antimicrobial agent when compared with the unmodified endophyte.

In one particular aspect, disclosed herein are bacterial endophytes with enhanced compatibility to the herbicide glyphosate. In one embodiment, the bacterial endophyte has a doubling time in growth medium containing at least 1 mM glyphosate, for example, at least 2 mM glyphosate, at least 5 mM glyphosate, at least 10 mM glyphosate, at least 15 mM glyphosate or more, that is no more than 250%, for example, no more than 200%, no more than 175%, no more than 150%, or no more than 125%, of the doubling time of the endophyte in the same growth medium containing no glyphosate. In one particular embodiment, the bacterial endophyte has a doubling time in growth medium containing 5 mM glyphosate that is no more than 150% the doubling time of the endophyte in the same growth medium containing no glyphosate.

In another embodiment, the bacterial endophyte has a doubling time in a plant tissue containing at least 10 ppm glyphosate, for example, at least 15 ppm glyphosate, at least 20 ppm glyphosate, at least 30 ppm glyphosate, at least 40 ppm glyphosate or more, that is no more than 250%, for example, no more than 200%, no more than 175%, no more than 150%, or no more than 125%, of the doubling time of the endophyte in a reference plant tissue containing no glyphosate. In one particular embodiment, the bacterial endophyte has a doubling time in a plant tissue containing 40 ppm glyphosate that is no more than 150% the doubling time of the endophyte in a reference plant tissue containing no glyphosate.

The selection process described above can be repeated to identify isolates of the endophyte that are compatible with a multitude of antifungal or antibacterial agents.

Candidate isolates can be tested to ensure that the selection for agrichemical compatibility did not result in loss of a desired microbial bioactivity. Isolates of the endophyte that are compatible with commonly employed fungicides can be selected as described above. The resulting compatible endophyte can be compared with the parental endophyte on plants in its ability to promote germination.

The agrichemical compatible endophytes generated as described above can be detected in samples. For example, where a transgene is introduced to render the endophyte compatible with the agrichemical(s), the transgene can be used as a target gene for amplification and detection by PCR. In addition, where point mutations or deletions to a portion of a specific gene or a number of genes results in compatibility with the agrichemical(s), the unique point mutations can likewise be detected by PCR or other means known in the art. Such methods allow the detection of the microbe even if it is no longer viable. Thus, commodity plant products produced using the agrichemical compatible microbes described herein can readily be identified by employing these and related methods of nucleic acid detection.

Beneficial Attributes of Synthetic Combinations of Cereal or Soy Seeds and Endophytes Improved Attributes Conferred by the Endophyte.

The present invention contemplates the establishment of a microbial symbiont in a plant. In one embodiment, the microbial association results in a detectable change to the seed or plant. The detectable change can be an improvement in a number of agronomic traits (e.g., improved general health, increased response to biotic or abiotic stresses, or enhanced properties of the plant or a plant part, including fruits and grains). Alternatively, the detectable change can be a physiological or biological change that can be measured by methods known in the art. The detectable changes are described in more detail in the sections below. As used herein, an endophyte is considered to have conferred an improved agricultural trait whether or not the improved trait arose from the plant, the endophyte, or the concerted action between the plant and endophyte. Therefore, for example, whether a beneficial hormone or chemical is produced by the plant or endophyte, for purposes of the present invention, the endophyte will be considered to have conferred an improved agronomic trait upon the host plant.

In some aspects, provided herein, are methods for producing a seed of a plant with a heritably altered trait. The trait of the plant can be altered without known genetic modification of the plant genome, and comprises the following steps. First, a preparation of an isolated endophyte which may be exogenous to the seed of the plant is provided, and optionally processed to produce a microbial preparation. The microbial preparation is then contacted with the plant. The plants are then allowed to go to seed, and the seeds, which contain the endophytes on and/or in the seed are collected. The endophytes contained within the seed are viably incorporated into the seed.

The method of the present invention can facilitate crop productivity by enhancing germination, seedling vigor and biomass in comparison with a non-treated control. Moreover, the introduction of the beneficial microorganisms to within the seed instead of to the surface by, e.g., seed coating, makes the endophytes less susceptible to environmental perturbation and more compatible with chemical seed coatings (e.g., pesticides and herbicides). Using endophyte colonized seeds, the plant growth and biomass increases are statistically similar to those obtained using conventional inoculation methods e.g., exogenous seed soaking and soil inoculation (that are more laborious and less practicable in certain circumstances).

Improved General Health.

Also described herein are plants, and fields of plants, that are associated with beneficial bacterial and/or fungal endophytes, such that the overall fitness, productivity or health of the plant or a portion thereof, is maintained, increased and/or improved over a period of time. Improvement in overall plant health can be assessed using numerous physiological parameters including, but not limited to, height, overall biomass, root and/or shoot biomass, seed germination, seedling survival, photosynthetic efficiency, transpiration rate, seed/fruit number or mass, plant grain or fruit yield, leaf chlorophyll content, photosynthetic rate, root length, or any combination thereof. Improved plant health, or improved field health, can also be demonstrated through improved resistance or response to a given stress, either biotic or abiotic stress, or a combination of one or more abiotic stresses, as provided herein.

Other Abiotic Stresses.

Disclosed herein are endophyte-associated plants with increased resistance to an abiotic stress. Exemplary abiotic stresses include, but are not limited to:

Drought and Heat Tolerance.

In some cases, a plant resulting from seeds containing the endophyte can exhibit a physiological change, such as a decreased change in photosynthetic activity (expressed, for example, as $\Delta Fv/Fm$) after exposure to heat shock or drought conditions as compared to a corresponding control, genetically identical plant that does not contain the endophytes grown in the same conditions. In some cases, the endophyte-associated plant as disclosed herein can exhibit an increased change in photosynthetic activity $\Delta Fv(\Delta Fv/Fm)$ after heat-shock or drought stress treatment, for example 1, 2, 3, 4, 5, 6, 7 days or more after the heat-shock or drought stress treatment, or until photosynthesis ceases, as compared with corresponding control plant of similar developmental stage but not containing the endophytes. For example, a plant having an endophyte able to confer heat and/or drought-tolerance can exhibit a $\Delta Fv/Fm$ of from about 0.1 to about 0.8 after exposure to heat-shock or drought stress or a $\Delta Fv/Fm$ range of from about 0.03 to about 0.8 under one day, or 1, 2, 3, 4, 5, 6, 7, or over 7 days post heat-shock or drought stress treatment, or until photosynthesis ceases. In some embodiments, stress-induced reductions in photosynthetic activity can be reduced by at least about 0.25% (for example, at least about 0.5%, at least about 1%, at least about 2%, at least about 3, at least about 5%, at least about 8%, at least about 10%, at least about 15%, at least about 20%, at least about 25%, at least about 30%, at least about 40%, at least about 50%, at least about 60%, at least about 75%, at least about 80%, at least about 80%, at least about 90%, at least about 95%, at least about 99% or at least 100%) as compared to the photosynthetic activity decrease in a corresponding reference agricultural plant following heat shock conditions. Significance of the difference between the endophyte-associated and reference agricultural plants can be established upon demonstrating statistical significance, for example at p<0.05 with an appropriate parametric or non-parametric statistic, e.g., Chi-square test, Student's t-test, Mann-Whitney test, or F-test based on the assumption or known facts that the endophyte-associated plant and reference agricultural plant have identical or near identical genomes.

In some embodiments, the plants contain endophytes able to confer novel heat and/or drought-tolerance in sufficient quantity, such that increased growth under conditions of heat or drought stress is observed. For example, a heat and/or drought-tolerance endophyte population described herein can be present in sufficient quantity in a plant, resulting in increased growth as compared to a plant that does not contain the endophyte, when grown under drought conditions or heat shock conditions, or following such conditions. Growth can be assessed with physiological parameters including, but not limited to, height, overall biomass, root and/or shoot biomass, seed germination, seedling survival, photosynthetic efficiency, transpiration rate, seed/fruit number or mass, plant grain or fruit yield, leaf chlorophyll content, photosynthetic rate, root length, or any combination thereof.

In some cases, a plant resulting from seeds containing an endophyte that includes a novel heat and/or drought tolerance endophyte population described herein exhibits a difference in the physiological parameter that is at least about 5% greater, for example at least about 5%, at least about 8%, at least about 10%, at least about 15%, at least about 20%, at least about 25%, at least about 30%, at least about 40%, at least about 50%, at least about 60%, at least about 75%, at least about 80%, at least about 80%, at least about 90%, or at least 100%, at least about 200%, at least about 300%, at least about 400% or greater than a reference agricultural plant grown under similar conditions.

In various embodiments, the endophytes introduced into altered seed microbiota can confer in the resulting plant thermal tolerance, herbicide tolerance, drought resistance, insect resistance, fungus resistance, virus resistance, bacteria resistance, male sterility, cold tolerance, salt tolerance, increased yield, enhanced nutrient use efficiency, increased nitrogen use efficiency, increased protein content, increased fermentable carbohydrate content, reduced lignin content, increased antioxidant content, enhanced water use efficiency, increased vigor, increased germination efficiency, earlier or increased flowering, increased biomass, altered root-to-shoot biomass ratio, enhanced soil water retention, or a combination thereof. A difference between endophyte-associated plant and a reference agricultural plant can also be measured using other methods known in the art (see, for example, Haake et al. (2002) *Plant Physiol.* 130: 639-648)

Salt Stress.

In other embodiments, endophytes able to confer increased tolerance to salinity stress can be introduced into plants. The resulting plants containing the endophytes can exhibit increased resistance to salt stress, whether measured in terms of survival under saline conditions, or overall growth during, or following salt stress. The physiological parameters of plant health recited above, including height, overall biomass, root and/or shoot biomass, seed germination, seedling survival, photosynthetic efficiency, transpiration rate, seed/fruit number or mass, plant grain or fruit yield, leaf chlorophyll content, photosynthetic rate, root length, or any combination thereof, can be used to measure growth, and compared with the growth rate of reference agricultural plants (e.g., isogenic plants without the endophytes) grown under identical conditions. In some cases, a plant resulting from seeds containing an endophyte able to confer salt tolerance described herein exhibits a difference in the physiological parameter that is at least about 5% greater, for example at least about 5%, at least about 8%, at least about 10%, at least about 15%, at least about 20%, at least about 25%, at least about 30%, at least about 40%, at least about 50%, at least about 60%, at least about 75%, at least about 80%, at least about 80%, at least about 90%, or at least 100%, at least about 200%, at least about 300%, at least about 400% or greater than a reference agricultural plant grown under the same sodium concentration in the soil.

In other instances, endophyte-associated plants and reference agricultural plants can be grown in soil or growth media containing different concentration of sodium to establish the inhibitory concentration of sodium (expressed, for example, as the concentration in which growth of the plant is inhibited by 50% when compared with plants grown under no sodium stress). Therefore, in another embodiment, a plant resulting from seeds containing an endophyte able to confer salt tolerance described herein exhibits an increase in the inhibitory sodium concentration by at least 10 mM, for example at least 15 mM, at least 20 mM, at least 30 mM, at least 40 mM, at least 50 mM, at least 60 mM, at least 70 mM, at least 80 mM, at least 90 mM, at least 100 mM or more, when compared with the reference agricultural plants.

High Metal Content.

Plants are sessile organisms and therefore must contend with the environment in which they are placed. While plants have adapted many mechanisms to deal with chemicals and substances that may be deleterious to their health, heavy metals represent a class of toxins which are highly relevant for plant growth and agriculture. Plants use a number of mechanisms to cope with toxic levels of heavy metals (for example, nickel, cadmium, lead, mercury, arsenic, or aluminum) in the soil, including excretion and internal sequestration. For agricultural purposes, it is important to have plants that are able to tolerate otherwise hostile conditions, for example soils containing elevated levels of toxic heavy metals. Endophytes that are able to confer increased heavy metal tolerance may do so by enhancing sequestration of the metal in certain compartments. Use of such endophytes in a plant would allow the development of novel plant-endophyte combinations for purposes of environmental remediation (also known as phytoremediation). Therefore, in one embodiment, the plant containing the endophyte able to confer increased metal tolerance exhibits a difference in a physiological parameter that is at least about 5% greater, for example at least about 5%, at least about 8%, at least about 10%, at least about 15%, at least about 20%, at least about 25%, at least about 30%, at least about 40%, at least about 50%, at least about 60%, at least about 75%, at least about 80%, at least about 80%, at least about 90%, or at least 100%, at least about 200%, at least about 300%, at least about 400% or greater than a reference agricultural plant grown under the same heavy metal concentration in the soil.

Alternatively, the inhibitory concentration of the heavy metal can be determined for the endophyte-associated plant and compared with a reference agricultural plant under the same conditions. Therefore, in one embodiment, the plants resulting from seeds containing an endophyte able to confer heavy metal tolerance described herein exhibit an increase in the inhibitory sodium concentration by at least 0.1 mM, for example at least 0.3 mM, at least 0.5 mM, at least 1 mM, at least 2 mM, at least 5 mM, at least 10 mM, at least 15 mM, at least 20 mM, at least 30 mM, at least 50 mM or more, when compared with the reference agricultural plants.

Finally, plants inoculated with endophytes that are able to confer increased metal tolerance exhibits an increase in overall metal accumulation by at least 10%, for example at least 15%, at least 20%, at least 30%, at least 40%, at least 50%, at least 60%, at least 75%, at least 100%, at least 150%, at least 200%, at least 300% or more, when compared with uninoculated plants grown under the same conditions.

Low Nutrient Stress.

The endophytes described herein may also confer to the plant an increased ability to grow in nutrient limiting conditions, for example by solubilizing or otherwise making available to the plants macronutrients or micronutrients that are complexed, insoluble, or otherwise in an unavailable form. In one embodiment, a plant is inoculated with an endophyte that confers increased ability to liberate and/or otherwise provide to the plant with nutrients selected from the group consisting of phosphate, nitrogen, potassium, iron, manganese, calcium, molybdenum, vitamins, or other micronutrients. Such a plant can exhibit increased growth in soil containing limiting amounts of such nutrients when compared with reference agricultural plant. Differences between the endophyte-associated plant and reference agricultural plant can be measured by comparing the biomass of the two plant types grown under limiting conditions, or by measuring the physical parameters described above. Therefore, in one embodiment, the plant containing the endophyte able to confer increased tolerance to nutrient limiting conditions exhibits a difference in a physiological parameter that is at least about 5% greater, for example at least about 5%, at least about 8%, at least about 10%, at least about 15%, at least about 20%, at least about 25%, at least about 30%, at least about 40%, at least about 50%, at least about 60%, at least about 75%, at least about 80%, at least about 80%, at least about 90%, or at least about 100%, at least about 200%, at least about 300%, at least about 400% or greater than a reference agricultural plant grown under the same heavy metal concentration in the soil.

Cold Stress.

In some cases, endophytes can confer to the plant the ability to tolerate cold stress. Many known methods exist for the measurement of a plant's tolerance to cold stress (as reviewed, for example, in Thomashow (2001) Plant Physiol. 125: 89-93, and Gilmour et al. (2000) Plant Physiol. 124: 1854-1865, both of which are incorporated herein by reference in their entirety). As used herein, cold stress refers to both the stress induced by chilling (0° C.-15° C.) and freezing (<0° C.). Some cultivars of agricultural plants can be particularly sensitive to cold stress, but cold tolerance traits may be multigenic, making the breeding process difficult. Endophytes able to confer cold tolerance would potentially reduce the damage suffered by farmers on an annual basis. Improved response to cold stress can be measured by survival of plants, the amount of necrosis of parts of the plant, or a change in crop yield loss, as well as the physiological parameters used in other examples. Therefore, in one embodiment, the plant containing the endophyte able to confer increased cold tolerance exhibits a difference in a physiological parameter that is at least about 5% greater, for example at least about 5%, at least about 8%, at least about 10%, at least about 15%, at least about 20%, at least about 25%, at least about 30%, at least about 40%, at least about 50%, at least about 60%, at least about 75%, at least about 80%, at least about 80%, at least about 90%, or at least about 100%, at least about 200%, at least about 300%, at least about 400% or greater than a reference agricultural plant grown under the same conditions of cold stress.

Biotic Stress.

In other embodiments, the bacterial endophyte protects the plant from a biotic stress, for example, insect infestation, nematode infestation, bacterial infection, fungal infection, oomycete infection, protozoal infection, viral infection, and herbivore grazing, or a combination thereof.

Insect Herbivory.

There is an abundance of insect pest species that can infect or infest a wide variety of plants. Pest infestation can lead to significant damage. Insect pests that infest plant species are particularly problematic in agriculture as they can cause serious damage to crops and significantly reduce plant yields. A wide variety of different types of plant are susceptible to pest infestation including commercial crops such as cotton, soybean, wheat, barley, and corn.

In some cases, the endophytes described herein may confer upon the host plant the ability to repel insect herbivores. In other cases, the endophytes may produce, or induce the production in the plant of, compounds which are insecticidal or insect repellant. The insect may be any one of the common pathogenic insects affecting plants, particularly agricultural plants. Examples include, but are not limited to: *Leptinotarsa* spp. (e.g., *L. decemlineata* (Colorado potato beetle), *L. juncta* (false potato beetle), or *L. texana* (Texan false potato beetle)); *Nilaparvata* spp. (e.g., *N. lugens* (brown planthopper)); *Laode/phax* spp. (e.g., *L. striatellus* (small brown planthopper)); *Nephotettix* spp. (e.g., *N. virescens* or *N. cincticeps* (green leafhopper), or *N. nigropictus* (rice leafhopper)); *Sogatella* spp. (e.g., *S. furcifera* (whitebacked planthopper)); *Chilo* spp. (e.g., *C. suppressalis* (rice striped stem borer), *C. auricilius* (gold-fringed stem borer), or *C. polychrysus* (dark-headed stem borer)); *Sesamia* spp. (e.g., *S. inferens* (pink rice borer)); *Tryporyza* spp. (e.g., *T. innotata* (white rice borer), or *T. incertulas* (yellow rice borer)); *Anthonomus* spp. (e.g., *A. grandis* (boll weevil)); *Phaedon* spp. (e.g., *P. cochleariae* (mustard leaf beetle)); *Epilachna* spp. (e.g., *E. varivetis* (Mexican bean beetle)); *Tribolium* spp. (e.g., *T. castaneum* (red floor beetle)); *Diabrotica* spp. (e.g., *D. virgifera* (western corn rootworm), *D. barberi* (northern corn rootworm), *D. undecimpunctata howardi* (southern corn rootworm), *D. virgifera zeae* (Mexican corn rootworm); *Ostrinia* spp. (e.g., *O. nubilalis* (European corn borer)); *Anaphothrips* spp. (e.g., *A. obscrurus* (grass *thrips*)); *Pectinophora* spp. (e.g., *P. gossypiella* (pink bollworm)); *Heliothis* spp. (e.g., *H. virescens* (tobacco budworm)); *Trialeurodes* spp. (e.g., *T. abutiloneus* (banded-winged whitefly) *T. vaporariorum* (greenhouse whitefly)); *Bemisia* spp. (e.g., *B. argentifolii* (silverleaf whitefly)); *Aphis* spp. (e.g., *A. gossypii* (cotton aphid)); *Lygus* spp. (e.g., *L. lineolaris* (tarnished plant bug) or *L. hesperus* (western tarnished plant bug)); *Euschistus* spp. (e.g., *E. conspersus* (consperse stink bug)); *Chlorochroa* spp. (e.g., *C. sayi* (Say stinkbug)); *Nezara* spp. (e.g., *N. viridula* (southern green stinkbug)); *Thrips* spp. (e.g., *T. tabaci* (onion *thrips*)); *Frankliniella* spp. (e.g., *F. fusca* (tobacco *thrips*), or *F.*

*occidentalis* (western flower *thrips*)); *Acheta* spp. (e.g., *A. domesticus* (house cricket)); *Myzus* spp. (e.g., *M. persicae* (green peach aphid)); *Macrosiphum* spp. (e.g., *M. euphorbiae* (potato aphid)); *Blissus* spp. (e.g., *B. leucopterus* (chinch bug)); *Acrosternum* spp. (e.g., *A. hilare* (green stink bug)); *Chilotraea* spp. (e.g., *C. polychrysa* (rice stalk borer)); *Lissorhoptrus* spp. (e.g., *L. oryzophilus* (rice water weevil)); *Rhopalosiphum* spp. (e.g., *R. maidis* (corn leaf aphid)); and *Anuraphis* spp. (e.g., *A. maidiradicis* (corn root aphid)).

The endophyte-associated plant can be tested for its ability to resist, or otherwise repel, pathogenic insects by measuring, for example, overall plant biomass, biomass of the fruit or grain, percentage of intact leaves, or other physiological parameters described herein, and comparing with a reference agricultural plant. In one embodiment, the endophyte-associated plant exhibits at least 5% greater biomass, for example, at least 10%, at least 15%, at least 20%, at least 30%, at least 40%, at least 50%, at least 75%, at least 100% or more biomass, than the reference agricultural plant grown under the same conditions (e.g., grown side-by-side, or adjacent to, the endophyte-associated plants). In other embodiments, the endophyte-associated plant exhibits at least 5% greater fruit or yield, for example, at least 10%, at least 15%, at least 20%, at least 30%, at least 40%, at least 50%, at least 75%, at least 100% or more fruit or yield, than the reference agricultural plant grown under the same conditions (e.g., grown side-by-side, or adjacent to, the endophyte-associated plants).

Nematodes.

Nematodes are microscopic roundworms that feed on the roots, fluids, leaves and stems of more than 2,000 row crops, vegetables, fruits, and ornamental plants, causing an estimated $100 billion crop loss worldwide and accounting for 13% of global crop losses due to disease. A variety of parasitic nematode species infect crop plants, including root-knot nematodes (RKN), cyst- and lesion-forming nematodes. Root-knot nematodes, which are characterized by causing root gall formation at feeding sites, have a relatively broad host range and are therefore parasitic on a large number of crop species. The cyst- and lesion-forming nematode species have a more limited host range, but still cause considerable losses in susceptible crops.

Signs of nematode damage include stunting and yellowing of leaves, and wilting of the plants during hot periods. Nematode infestation, however, can cause significant yield losses without any above-ground disease symptoms. The primary causes of yield reduction are due to underground root damage. Roots infected by SCN are dwarfed or stunted. Nematode infestation also can decrease the number of nitrogen-fixing nodules on the roots, and may make the roots more susceptible to attacks by other soil-borne plant nematodes.

In one embodiment, the endophyte-associated plant has an increased resistance to a nematode when compared with a reference agricultural plant. As before with insect herbivores, biomass of the plant or a portion of the plant, or any of the other physiological parameters mentioned elsewhere, can be compared with the reference agricultural plant grown under the same conditions. Particularly useful measurements include overall plant biomass, biomass and/or size of the fruit or grain, and root biomass. In one embodiment, the endophyte-associated plant exhibits at least 5% greater biomass, for example, at least 10%, at least 15%, at least 20%, at least 30%, at least 40%, at least 50%, at least 75%, at least 100% or more biomass, than the reference agricultural plant grown under the same conditions (e.g., grown side-by-side, or adjacent to, the endophyte-associated plants, under conditions of nematode challenge). In another embodiment, the endophyte-associated plant exhibits at least 5% greater root biomass, for example, at least 10%, at least 15%, at least 20%, at least 30%, at least 40%, at least 50%, at least 75%, at least 100% or more root biomass, than the reference agricultural plant grown under the same conditions (e.g., grown side-by-side, or adjacent to, the endophyte-associated plants, under conditions of nematode challenge). In still another embodiment, the endophyte-associated plant exhibits at least 5% greater fruit or yield, for example, at least 10%, at least 15%, at least 20%, at least 30%, at least 40%, at least 50%, at least 75%, at least 100% or more fruit or yield, than the reference agricultural plant grown under the same conditions (e.g., grown side-by-side, or adjacent to, the endophyte-associated plants, under conditions of nematode challenge).

Fungal Pathogens.

Fungal diseases are responsible for yearly losses of over $10 Billion on agricultural crops in the US, represent 42% of global crop losses due to disease, and are caused by a large variety of biologically diverse pathogens. Different strategies have traditionally been used to control them. Resistance traits have been bred into agriculturally important varieties, thus providing various levels of resistance against either a narrow range of pathogen isolates or races, or against a broader range. However, this involves the long and labor intensive process of introducing desirable traits into commercial lines by genetic crosses and, due to the risk of pests evolving to overcome natural plant resistance, a constant effort to breed new resistance traits into commercial lines is required. Alternatively, fungal diseases have been controlled by the application of chemical fungicides. This strategy usually results in efficient control, but is also associated with the possible development of resistant pathogens and can be associated with a negative impact on the environment. Moreover, in certain crops, such as barley and wheat, the control of fungal pathogens by chemical fungicides is difficult or impractical.

The present invention contemplates the use of endophytes which are able to confer resistance to fungal pathogens to the host plant. Increased resistance to fungal inoculation can be measured, for example, using any of the physiological parameters presented above, by comparing with reference agricultural plants. In one embodiment, the endophyte-associated plant exhibits at least 5% greater biomass, for example, at least 10%, at least 15%, at least 20%, at least 30%, at least 40%, at least 50%, at least 75%, at least 100% or more biomass, than the reference agricultural plant grown under the same conditions (e.g., grown side-by-side, or adjacent to, the endophyte-associated plants, infected with the fungal pathogen). In still another embodiment, the endophyte-associated plant exhibits at least 5% greater fruit or yield, for example, at least 10%, at least 15%, at least 20%, at least 30%, at least 40%, at least 50%, at least 75%, at least 100% or more fruit or yield, than the reference agricultural plant grown under the same conditions (e.g., grown side-by-side, or adjacent to, the endophyte-associated plants, infected with the fungal pathogen). In another embodiment, the endophyte-associated plant exhibits at least a 5% reduction in for hyphal growth, for example, at least 10%, at least 15%, at least 20%, at least 30%, at least 40%, at least 50%, at least 75%, at least 90% reduction or more, in hyphal growth, than the reference agricultural plant grown under the same conditions (e.g., grown side-by-side, or adjacent to, the endophyte-associated plants, infected with the fungal pathogen).

Viral Pathogens.

Plant viruses are estimated to account for 18% of global crop losses due to disease. There are numerous examples of viral pathogens affecting agricultural productivity. Examples include the American wheat striate mosaic virus (AWSMV) (wheat striate mosaic), Barley stripe mosaic virus (BSMV), Barley yellow dwarf virus (BYDV), Brome mosaic virus (BMV), Cereal chlorotic mottle virus (CCMV), Corn chlorotic vein banding virus (CCVBV), Brazilian maize mosaic virus, Corn lethal necrosis Virus complex from Maize chlorotic mottle virus, (MCMV), Maize dwarf mosaic virus (MDMV), A or B Wheat streak mosaic virus (WSMV), Cucumber mosaic virus (CMV), Cynodon chlorotic streak virus (CCSV), Johnsongrass mosaic virus (JGMV), Maize bushy stunt Mycoplasma-like organism (MLO) associated virus, Maize chlorotic dwarf Maize chlorotic dwarf virus (MCDV), Maize chlorotic mottle virus (MCMV), Maize dwarf mosaic virus (MDMV), strains A, D, E and F, Maize leaf fleck virus (MLFV), Maize line virus (MLV), Maize mosaic (corn leaf stripe, Maize mosaic virus (MMV), enanismo rayado), Maize mottle and chlorotic stunt virus, Maize pellucid ringspot virus (MPRV), Maize raga gruesa virus (MRGV), Maize rayado fino (fine striping) virus (MRFV), Maize red stripe virus (MRSV), Maize ring mottle virus (MRMV), Maize rio cuarto virus (MRCV), Maize rough dwarf virus (MRDV), Cereal tillering disease virus, Maize sterile stunt virus, barley yellow striate virus, Maize streak virus (MSV), Maize stripe virus, Maize chloroticstripe virus, maize hoja blanca virus, Maize stunting virus; Maize tassel abortion virus (MTAV), Maize vein enation virus (MVEV), Maize wallaby ear virus (MWEV), Maize white leaf virus, Maize white line mosaic virus (MWLMV), Millet red leaf virus (MRLV), Northern cereal mosaic virus (NCMV), Oat pseudorosette virus, (zakuklivanie), Oat sterile dwarf virus (OSDV), Rice black-streaked dwarf virus (RBSDV), Rice stripe virus (RSV), Sorghum mosaic virus (SrMV), Sugarcane mosaic virus (SCMV) strains H, 1 and M, Sugarcane Fiji disease virus (FDV), Sugarcane mosaic virus (SCMV) strains A, B, D, E, SC, BC, Sabi and MB (formerly MDMV-B), and Wheat spot mosaic virus (WSMV). In one embodiment, the endophyte-associated plant provides protection against viral pathogens such that there is at least 5% greater biomass, for example, at least 10%, at least 15%, at least 20%, at least 30%, at least 40%, at least 50%, at least 75%, at least 100% or more biomass, than the reference agricultural plant grown under the same conditions. In still another embodiment, the endophyte-associated plant exhibits at least 5% greater fruit or yield, for example, at least 10%, at least 15%, at least 20%, at least 30%, at least 40%, at least 50%, at least 75%, at least 100% or more fruit or yield when challenged with a virus, than the reference agricultural plant grown under the same conditions. In yet another embodiment, the endophyte-associated plant exhibits at least 5% lower viral titer, for example, at least 10%, at least 15%, at least 20%, at least 30%, at least 40%, at least 50%, at least 75%, at least 100% lower viral titer when challenged with a virus, than the reference agricultural plant grown under the same conditions.

Bacterial Pathogens.

Likewise, bacterial pathogens are a significant problem negatively affecting agricultural productivity and accounting for 27% of global crop losses due to plant disease. In one embodiment, the endophyte-associated plant described herein provides protection against bacterial pathogens such that there is at least 5% greater biomass, for example, at least 10%, at least 15%, at least 20%, at least 30%, at least 40%, at least 50%, at least 75%, at least 100% or more biomass, than the reference agricultural plant grown under the same conditions. In still another embodiment, the endophyte-associated plant exhibits at least 5% greater fruit or yield, for example, at least 10%, at least 15%, at least 20%, at least 30%, at least 40%, at least 50%, at least 75%, at least 100% or more fruit or yield when challenged with a bacterial pathogen, than the reference agricultural plant grown under the same conditions. In yet another embodiment, the endophyte-associated plant exhibits at least 5% lower bacterial count, for example, at least 10%, at least 15%, at least 20%, at least 30%, at least 40%, at least 50%, at least 75%, at least 100% lower bacterial count when challenged with a bacteria, than the reference agricultural plant grown under the same conditions.

Improvement of Other Traits.

In other embodiments, the inoculated endophyte can confer other beneficial traits to the plant. Improved traits can include an improved nutritional content of the plant or plant part used for human consumption. In one embodiment, the endophyte-associated plant is able to produce a detectable change in the content of at least one nutrient. Examples of such nutrients include amino acid, protein, oil (including any one of Oleic acid, Linoleic acid, Alpha-linolenic acid, Saturated fatty acids, Palmitic acid, Stearic acid and Trans fats), carbohydrate (including sugars such as sucrose, glucose and fructose, starch, or dietary fiber), Vitamin A, Thiamine (vit. B1), Riboflavin (vit. B2), Niacin (vit. B3), Pantothenic acid (B5), Vitamin B6, Folate (vit. B9), Choline, Vitamin C, Vitamin E, Vitamin K, Calcium, Iron, Magnesium, Manganese, Phosphorus, Potassium, Sodium, Zinc. In one embodiment, the endophyte-associated plant or part thereof contains at least 10% more nutrient, for example, at least 20%, at least 30%, at least 40%, at least 50%, at least 60%, at least 70%, at least 80%, at least 90%, at least 100%, at least 150%, at least 200%, at least 300% or more, of the nutrient when compared with reference agricultural plants.

In other cases, the improved trait can include reduced content of a harmful or undesirable substance when compared with reference agricultural plants. Such compounds include those which are harmful when ingested in large quantities or are bitter tasting (for example, oxalic acid, amygdalin, certain alkaloids such as solanine, caffeine, nicotine, quinine and morphine, tannins, cyanide). As such, in one embodiment, the endophyte-associated plant or part thereof contains at least 10% less of the undesirable substance, for example, at least 20%, at least 30%, at least 40%, at least 50%, at least 60%, at least 70%, at least 80%, at least 90%, at least 95%, at least 98%, at least 99% less of the undesirable substance when compared with reference agricultural plant. In a related embodiment, the improved trait can include improved taste of the plant or a part of the plant, including the fruit or seed. In a related embodiment, the improved trait can include reduction of undesirable compounds produced by other endophytes in plants, such as degradation of *Fusarium* produced deoxynivalenol (also known as vomitoxin and a virulence factor involved in *Fusarium* head blight of maize and wheat) in a part of the plant, including the fruit or seed.

In other cases, the improved trait can be an increase in overall biomass of the plant or a part of the plant, including its fruit or seed.

The endophyte-associated plant can also have an altered hormone status or altered levels of hormone production when compared with a reference agricultural plant. An alteration in hormonal status may affect many physiological parameters, including flowering time, water efficiency, apical dominance and/or lateral shoot branching, increase in root hair, and alteration in fruit ripening.

The seed endophytes described herein can provide important agronomic advantages to soybean plants containing effective amounts of the seed endophytes, as well as to fields containing populations of soybean plants. Exemplary agronomic advantages present in a single soybean plant, or a collection, association or population of soybean plants (herein, a "field") include yield, relative maturity (RM) group or ranking, days to emergence, canopy type (e.g., as relating to affecting penetration of sprayed-on chemicals or sensitivity to fungal infection), plant height, standability, stress tolerance, days to flower, seed filling period, pubescence color, pod color, Hilum color, protein content (e.g., % Protein @13% moisture), oil content (e.g., % Oil @13% moisture), or disease resistance including *Phytophthora*, Soybean Cyst Nematode (SCN), Iron Deficiency Chlorosis (IDC), Brown Stem Rot (BSR), *Sclerotinia* White Mold (SWM), Sudden Death Syndrome (SDS), Iron Deficiency Chlorosis/Salt (IDC/SALT), frogeye leaf spot, root knot nematode, stem canker, or soybean cyst nematode.

The association between the endophyte and the plant can also be detected using other methods known in the art. For example, the biochemical, metabolomics, proteomic, genomic, epigenomic and/or trasncriptomic profiles of endophyte-associated plants can be compared with reference agricultural plants under the same conditions.

Metabolomic differences between the plants can be detected using methods known in the art. For example, a biological sample (whole tissue, exudate, phloem sap, xylem sap, root exudate, etc.) from the endophyte-associated and reference agricultural plants can be analyzed essentially as described in Fiehn et al., (2000) Nature Biotechnol., 18, 1157-1161, or Roessner et al., (2001) Plant Cell, 13, 11-29. Such metabolomic methods can be used to detect differences in levels in hormone, nutrients, secondary metabolites, root exudates, phloem sap content, xylem sap content, heavy metal content, and the like. Such methods are also useful for detecting alterations in microbial content and status; for example, the presence and levels of bacterial/fungal signaling molecules (e.g., autoinducers and pheromones), which can indicate the status of group-based behavior of endophytes based on, for example, population density (see, for example Daniels et al., (2006). PNAS 103: 14965-14970. Eberhard et al., (1981). Biochemistry 20 (9): 2444-2449). Transcriptome analysis (reviewed, for example, in Usadel & Fernie, (2013). Front Plant Sci. 4:48) of endophyte-associated and reference agricultural plants can also be performed to detect changes in expression of at least one transcript, or a set or network of genes upon endophyte association. Similarly, epigenetic changes can be detected using methylated DNA immunoprecipitation followed by high-throughput sequencing (Vining et al., (2013) BMC Plant Biol. 13:92).

Combinations of Endophytic Microbes

Combinations of endophytic microbes such as seed bacterial endophytes can be selected by any one or more of several criteria. In one embodiment, compatible endophytic populations are selected. As used herein, compatibility refers to microbial populations which do not significantly interfere with the growth and propagation of the other. Incompatible microbial populations can arise, for example, where one of the populations produces or secrets a compound which is toxic or deleterious to the growth of the other population(s). Incompatibility arising from production of deleterious compounds/agents can be detected using methods known in the art, and as described herein elsewhere. Similarly, the distinct populations can compete for limited resources in a way that makes co-existence difficult.

In another embodiment, combinations are selected on the basis of compounds produced by each population. For example, the first population is capable of producing siderophores, and another population is capable of producing anti-fungal compounds. In one embodiment, the first population of bacterial endophytes is capable of a function selected from the group consisting of auxin production, nitrogen fixation, production of an antimicrobial compound, siderophore production, mineral phosphate solubilization, cellulase production, chitinase production, xylanase production, and acetoin production. In another embodiment, the second population of bacterial endophytes is capable of a function selected from the group consisting of auxin production, nitrogen fixation, production of an antimicrobial compound, siderophore production, mineral phosphate solubilization, cellulase production, chitinase production, xylanase production, and acetoin production. In still another embodiment, the first and second populations are capable of at least one different function.

In still another embodiment, the combinations are selected which display distinct localization in the plant after colonization. For example, the first population can colonize, and in some cases preferentially colonize, the root tissue, while a second population can be selected on the basis of its preferential colonization of the aerial parts of the agricultural plant. Therefore, in one embodiment, the first population is capable of colonizing one or more of the tissues selected from the group consisting of a root, shoot, leaf, flower, and seed. In another embodiment, the second population is capable of colonizing one or more tissues selected from the group consisting of root, shoot, leaf, flower, and seed. In still another embodiment, the first and second populations are capable of colonizing a different tissue within the agricultural grass plant.

In still another embodiment, the combinations of endophytes are selected which confer one or more distinct fitness traits on the inoculated agricultural plant, either individually or in synergistic association with other endophytes. Alternatively, two or more endophytes induce the colonization of a third endophyte. For example, the first population is selected on the basis that it confers significant increase in biomass, while the second population promotes increased drought tolerance on the inoculated agricultural plant. Therefore, in one embodiment, the first population is capable of conferring at least one trait selected from the group consisting of thermal tolerance, herbicide tolerance, drought resistance, insect resistance, fungus resistance, virus resistance, bacteria resistance, male sterility, cold tolerance, salt tolerance, increased yield, enhanced nutrient use efficiency, increased nitrogen use efficiency, increased fermentable carbohydrate content, reduced lignin content, increased antioxidant content, enhanced water use efficiency, increased vigor, increased germination efficiency, earlier or increased flowering, increased biomass, altered root-to-shoot biomass ratio, enhanced soil water retention, or a combination thereof. In another embodiment, the second population is capable of conferring a trait selected from the group consisting of thermal tolerance, herbicide tolerance, drought resistance, insect resistance, fungus resistance, virus resistance, bacteria resistance, male sterility, cold tolerance, salt tolerance, increased yield, enhanced nutrient use efficiency, increased nitrogen use efficiency, increased fermentable carbohydrate content, reduced lignin content, increased antioxidant content, enhanced water use efficiency, increased vigor, increased germination efficiency, earlier or increased flowering, increased biomass, altered root-to-shoot biomass ratio, enhanced soil water retention, or a combination thereof. In still another embodiment, each of the first and second population is capable of conferring a different trait selected from the group consisting of thermal tolerance, herbicide tolerance, drought resistance, insect resistance, fungus resistance, virus resistance, bacteria resistance, male sterility, cold tolerance, salt tolerance, increased yield, enhanced nutrient use efficiency, increased nitrogen use efficiency, increased fermentable carbohydrate content, reduced lignin content, increased antioxidant content, enhanced water use efficiency, increased vigor, increased germination efficiency, earlier or increased flowering, increased biomass, altered root-to-shoot biomass ratio, enhanced soil water retention, or a combination thereof.

The combinations of endophytes can also be selected based on combinations of the above criteria. For example, the first population can be selected on the basis of the compound it produces (e.g., its ability to fix nitrogen, thus providing a potential nitrogen source to the plant), while the second population is selected on the basis of its ability to confer increased resistance of the plant to a pathogen (e.g., a fungal pathogen).

Tables 14A-14F provide numerous examples of combinations of seed bacterial endophytes that can be used to prepare synthetic combinations, agricultural formulations, seed treatments, or agricultural products.

Formulations/Compositions/Seed Coating Compositions

The purified bacterial populations described herein can be formulated using an agriculturally compatible carrier or agriculturally acceptable carrier. The formulation useful for these embodiments generally typically include at least one member selected from the group consisting of a tackifier, a microbial stabilizer, a fungicide, an antibacterial agent, an herbicide, a nematicide, an insecticide, a plant growth regulator, a fertilizer, a rodenticide, a dessicant, and a nutrient. For example, any of the compositions described herein can include an agriculturally acceptable carrier (e.g., one or more of a fertilizer such as a non-naturally occurring fertilizer, an adhesion agent such as a non-naturally occurring adhesion agent, and a pesticide such as a non-naturally occurring pesticide). A non-naturally occurring adhesion agent can be, for example, a polymer, copolymer, or synthetic wax. For example, any of the coated seeds, seedlings, or plants described herein (e.g., coated *Glycine max* or agricultural grass plant seeds, seedlings, or plants) can contain such an agriculturally acceptable carrier in the seed coating. In any of the compositions or methods described herein, an agriculturally acceptable carrier can be or can include a non-naturally occurring compound (e.g., a non-naturally occurring fertilizer, a non-naturally occurring adhesion agent such as a polymer, copolymer, or synthetic wax, or a non-naturally occurring pesticide). Non-limiting examples of agriculturally acceptable carriers are described below. Additional examples of agriculturally acceptable carriers are known in the art.

In some cases, the purified bacterial population is mixed with an agriculturally compatible carrier. The carrier can be a solid carrier or liquid carrier, and in various forms including microsphres, powders, emulsions and the like. The carrier may be any one or more of a number of carriers that confer a variety of properties, such as increased stability, wettability, or dispersability. Wetting agents such as natural or synthetic surfactants, which can be nonionic or ionic surfactants, or a combination thereof can be included in a composition of the invention. Water-in-oil emulsions can also be used to formulate a composition that includes the purified bacterial population (see, for example, U.S. Pat. No. 7,485,451, which is incorporated herein by reference in its entirety). Suitable formulations that may be prepared include wettable powders, granules, gels, agar strips or pellets, thickeners, and the like, microencapsulated particles, and the like, liquids such as aqueous flowables, aqueous suspensions, water-in-oil emulsions, etc. The formulation may include grain or legume products, for example, ground grain or beans, broth or flour derived from grain or beans, starch, sugar, or oil.

In some embodiments, the agricultural carrier may be soil or a plant growth medium. Other agricultural carriers that may be used include water, fertilizers, plant-based oils, humectants, or combinations thereof. Alternatively, the agricultural carrier may be a solid, such as diatomaceous earth, loam, silica, alginate, clay, bentonite, vermiculite, seed cases, other plant and animal products, or combinations, including granules, pellets, or suspensions. Mixtures of any of the aforementioned ingredients are also contemplated as carriers, such as but not limited to, pesta (flour and kaolin clay), agar or flour-based pellets in loam, sand, or clay, etc. Formulations may include food sources for the cultured organisms, such as barley, rice, or other biological materials such as seed, plant parts, sugar cane bagasse, hulls or stalks from grain processing, ground plant material or wood from building site refuse, sawdust or small fibers from recycling of paper, fabric, or wood. Other suitable formulations will be known to those skilled in the art.

For example, a fertilizer can be used to help promote the growth or provide nutrients to a seed, seedling, or plant (e.g., a *Glycine max* seed, seedling, or plant). Non-limiting examples of fertilizers include nitrogen, phosphorous, potassium, calcium, sulfur, magnesium, boron, chloride, manganese, iron, zinc, copper, molybdenum, and selenium (or a salt thereof). Additional examples of fertilizers include one or more amino acids, salts, carbohydrates, vitamins, glucose, NaCl, yeast extract, $NH_4H_2PO_4$, $(NH_4)_2SO_4$, glycerol, valine, L-leucine, lactic acid, propionic acid, succinic acid, malic acid, citric acid, KH tartrate, xylose, lyxose, and lecithin.

In one embodiment, the formulation can include a tackifier or adherent (referred to as an adhesive agent) to help bind other active agents to a substance (e.g., a surface of a seed, e.g., a *Glycine max* seed). Such agents are useful for combining the bacterial population of the invention with carriers that can contain other compounds (e.g., control agents that are not biologic), to yield a coating composition. Such compositions help create coatings around the plant or seed to maintain contact between the microbe and other agents with the plant or plant part. In one embodiment, adhesives are selected from the group consisting of: alginate, gums, starches, lecithins, formononetin, polyvinyl alcohol, alkali formononetinate, hesperetin, polyvinyl acetate, cephalins, Gum Arabic, Xanthan Gum, Mineral Oil, Polyethylene Glycol (PEG), Polyvinyl pyrrolidone (PVP), Arabino-galactan, Methyl Cellulose, PEG 400, Chitosan, Polyacrylamide, Polyacrylate, Polyacrylonitrile, Glycerol, Triethylene glycol, Vinyl Acetate, Gellan Gum, Polystyrene, Polyvinyl, Carboxymethyl cellulose, Gum Ghatti, and polyoxyethylene-polyoxybutylene block copolymers.

In some embodiments, the adhesives can be, e.g. a wax such as carnauba wax, beeswax, Chinese wax, shellac wax, spermaceti wax, candelilla wax, castor wax, ouricury wax, and rice bran wax, a polysaccharide (e.g., starch, dextrins, maltodextrins, alginate, and chitosans), a fat, oil, a protein (e.g., gelatin and zeins), gum arabics, and shellacs. Adhesive agents can be non-naturally occurring compounds, e.g., polymers, copolymers, and waxes. For example, non-limiting examples of polymers that can be used as an adhesive agent include: polyvinyl acetates, polyvinyl acetate copolymers, ethylene vinyl acetate (EVA) copolymers, polyvinyl alcohols, polyvinyl alcohol copolymers, celluloses (e.g., ethylcelluloses, methylcelluloses, hydroxymethylcelluloses, hydroxypropylcelluloses, and carboxymethylcelluloses), polyvinylpyrolidones, vinyl chloride, vinylidene chloride copolymers, calcium lignosulfonates, acrylic copolymers, polyvinylacrylates, polyethylene oxide, acylamide polymers and copolymers, polyhydroxyethyl acrylate, methylacrylamide monomers, and polychloroprene. Additional examples of non-naturally occurring adhesive agents include synthetic waxes. Additional examples of adhesive agents are described in U.S. Pat. No. 7,213,367 (incorporated herein by reference). Other examples of adherent compositions that can be used in the synthetic preparation include those described in EP 0818135, CA 1229497, WO 2013090628, EP 0192342, WO 2008103422 and CA 1041788, each of which is incorporated herein by reference in its entirety.

In some examples, one or more of the adhesion agents, anti-fungal agents, growth regulation agents, and pesticides (e.g., insecticide) are non-naturally occurring compounds (e.g., in any combination). Additional examples of agriculturally acceptable carriers include dispersants (e.g., polyvinylpyrrolidone/vinyl acetate PVPIVA S-630), surfactants, binders, and filler agents.

The formulation can also contain a surfactant. Non-limiting examples of surfactants include nitrogen-surfactant blends such as Prefer 28 (Cenex), Surf-N(US), Inhance (Brandt), P-28 (Wilfarm) and Patrol (Helena); esterified seed oils include Sun-It II (AmCy), MSO (UAP), Scoil (Agsco), Hasten (Wilfarm) and Mes-100 (Drexel); and organo-silicone surfactants include Silwet L77 (UAP), Silikin (Terra), Dyne-Amic (Helena), Kinetic (Helena), Sylgard 309 (Wilbur-Ellis) and Century (Precision). In one embodiment, the surfactant is present at a concentration of between 0.01% v/v to 10% v/v. In another embodiment, the surfactant is present at a concentration of between 0.1% v/v to 1% v/v.

In certain cases, the formulation includes a microbial stabilizer. Such an agent can include a desiccant. As used herein, a "desiccant" can include any compound or mixture of compounds that can be classified as a desiccant regardless of whether the compound or compounds are used in such concentrations that they in fact have a desiccating effect on the liquid inoculant. Such desiccants are ideally compatible with the bacterial population used, and should promote the ability of the microbial population to survive application on the seeds and to survive desiccation. Examples of suitable desiccants include one or more of trehalose, sucrose, glycerol, and Methylene glycol. Other suitable desiccants include, but are not limited to, non reducing sugars and sugar alcohols (e.g., mannitol or sorbitol). The amount of desiccant introduced into the formulation can range from about 5% to about 50% by weight/volume, for example, between about 10% to about 40%, between about 15% and about 35%, or between about 20% and about 30%.

In some cases, it is advantageous for the formulation to contain agents such as a fungicide, an antibacterial agent, an herbicide, a nematicide, an insecticide, a plant growth regulator, a rodenticide, or a nutrient. Non-limiting examples of growth regulators include brassinosteroids, cytokinines (e.g., kinetin and zeatin), auxins (e.g., indolylacetic acid and indolylacetyl aspartate), flavonoids and isoflavanoids (e.g., formononetin and diosmetin), phytoaixins (e.g., glyceol-line), and phytoalexin-inducing oligosaccharides (e.g., pectin, chitin, chitosan, polygalacuronic acid, and oligogalacturonic acid), and gibellerins. Such agents are ideally compatible with the agricultural seed or seedling onto which the formulation is applied (e.g., it should not be deleterious to the growth or health of the plant). Furthermore, the agent is ideally one which does not cause safety concerns for human, animal or industrial use (e.g., no safety issues, or the compound is sufficiently labile that the commodity plant product derived from the plant contains negligible amounts of the compound).

In the liquid form, for example, solutions or suspensions, the bacterial endophytic populations of the present invention can be mixed or suspended in water or in aqueous solutions. Suitable liquid diluents or carriers include water, aqueous solutions, petroleum distillates, or other liquid carriers.

Solid compositions can be prepared by dispersing the bacterial endophytic populations of the invention in and on an appropriately divided solid carrier, such as peat, wheat, bran, vermiculite, clay, talc, bentonite, diatomaceous earth, fuller's earth, pasteurized soil, and the like. When such formulations are used as wettable powders, biologically compatible dispersing agents such as non-ionic, anionic, amphoteric, or cationic dispersing and emulsifying agents can be used.

The solid carriers used upon formulation include, for example, mineral carriers such as kaolin clay, pyrophyllite, bentonite, montmorillonite, diatomaceous earth, acid white soil, vermiculite, and pearlite, and inorganic salts such as ammonium sulfate, ammonium phosphate, ammonium nitrate, urea, ammonium chloride, and calcium carbonate. Also, organic fine powders such as wheat flour, wheat bran, and rice bran may be used. The liquid carriers include vegetable oils such as soybean oil and cottonseed oil, glycerol, ethylene glycol, polyethylene glycol, propylene glycol, polypropylene glycol, etc.

In one particular embodiment, the formulation is ideally suited for coating of the endophytic microbial population onto seeds. The bacterial endophytic populations described in the present invention are capable of conferring many fitness benefits to the host plants. The ability to confer such benefits by coating the bacterial populations on the surface of seeds has many potential advantages, particularly when used in a commercial (agricultural) scale.

The bacterial endophytic populations herein can be combined with one or more of the agents described above to yield a formulation suitable for combining with an agricultural seed or seedling. The bacterial population can be obtained from growth in culture, for example, using a synthetic growth medium. In addition, the microbe can be cultured on solid media, for example on petri dishes, scraped off and suspended into the preparation. Microbes at different growth phases can be used. For example, microbes at lag phase, early-log phase, mid-log phase, late-log phase, stationary phase, early death phase, or death phase can be used.

The formulations including the bacterial endophytic population of the present invention typically contains between about 0.1 to 95% by weight, for example, between about 1% and 90%, between about 3% and 75%, between about 5% and 60%, between about 10% and 50% in wet weight of the bacterial population of the present invention. It is preferred that the formulation contains at least about $10^3$ CFU per ml of formulation, for example, at least about $10^4$, at least about $10^5$, at least about $10^6$, at least $10^7$ CFU, at least $10^8$ CFU per ml of formulation.

Coated Seeds

Also provided herein are a coated seed or plurality of coated seeds (e.g., a *Glycine max* seed or agricultural grass seed), wherein the coating on the seed(s) includes an adhesion agent (e.g., any of the exemplary adhesion agents described herein) and a seed endophyte (e.g., any of the exemplary seed endophytes described herein that confer upon plants produced from the seeds, as compared to a reference seed (e.g., a reference *Glycine max* or agricultural grass seed), at least one trait selected from the group consisting of: increased root biomass, increased root length, increased height, increased shoot length, increased leaf number, increased water-use efficiency, increased overall biomass, increased photosynthesis rate, increased tolerance to drought, increased heat tolerance, increased resistance to nematode stress, increased resistance to a fungal pathogen, increased resistance to a bacterial pathogen, increased resistance to a viral pathogen, an increased level of one or more plant hormones, an increased level of a metabolie, or a shift in the proteomic expression profile (see, e.g., Tables 16 and 17). The adhesion agent in these seed coating can be a non-naturally occurring compound (e.g., a polymer, copolymer, or a synthetic wax). Non-limiting examples of such non-naturally occurring adhesive agents are described herein. Additional examples of non-naturally occurring adhesive agents are known in the art. A non-natural adhesive agent can be a polymer that allows for temperature regulated water permeation. Such a seed coating can be on any of the exemplary seeds described herein such as seeds containing a heterologous nucleic acid sequence. It will be appreciated that the seeds can be coated by spraying, immersing, encapsulating, injecting, or dusting the seeds with an adhesive agent and any of the compositions described herein.

Also provided herein are a seed or plurality of coated seeds (e.g., *Glycine max* seed or agricultural grass seed), wherein the coating on the seed(s) (e.g., any of the exemplary seeds described herein, e.g., seeds containing a heterologous or exogenous nucleic acid sequence) includes one or both of a pesticide (e.g., a fungicide) and a fertilizer, and a seed endophyte (e.g., any of the exemplary seed-origin endophytes described herein) that confers upon plants produced from the seeds, as compared to a reference seed (e.g., a reference *Glycine max* or agricultural grass seed), at least one trait selected from the group consisting of: increased root biomass, increased root length, increased height, increased shoot length, increased leaf number, increased water-use efficiency, increased overall biomass, increased photosynthesis rate, increased tolerance to drought, increased heat tolerance, increased resistance to nematode stress, increased resistance to a fungal pathogen, increased resistance to a bacterial pathogen, increased resistance to a viral pathogen, an increased level of one or more plant hormones, an increased level of a metabolie, or a shift in the proteomic expression profile (see, e.g., Tables 16 and 17). The pesticide (e.g., fungicide) in the seed coating can be a non-naturally occurring compound. The fertilizer in the seed coating can be a non-naturally occurring compound. Non-limiting examples of such non-naturally occurring pesticides (e.g., fungicides) and non-naturally occurring fertilizers are described herein. Additional examples of non-naturally occurring pesticides (e.g., fungicides) and non-naturally occurring fertilizers are known in the art. It will be appreciated that the seeds can be coated by spraying, immersing, encapsulating, injecting, or dusting the seeds with a fertilizer and/or pesticide or any of the compositions described herein.

Enriched Seeds/Seedlings/Plants

Also provided herein are seed bacterial endophyte-enriched seeds (e.g., *Glycine max* seed or agricultural grass seed), where the seeds have an endophyte population enriched to include 10% or more (e.g., 12% or more, 14% or more, 16% or more, 18% or more, 20% or more, 25% or more, 30% or more, 35% or more, 40% or more, 45% or more, or 50% or more) of a seed bacterial endophyte entity (e.g., any of the seed bacterial endophytes described herein) that confer upon plants produced from the seed at least one trait selected from the group consisting of: increased root biomass, increased root length, increased height, increased shoot length, increased leaf number, increased water use efficiency, increased overall biomass, increased photosynthesis rate, increased tolerance to drought, increased heat tolerance, increased salt tolerance, increased resistance to nematode stress, increased resistance to fungal pathogen, increased resistance to a bacterial pathogen, increased resistance to a viral pathogen, an increased level of one or more plant hormones, an increased level of a metabolite, or an altered proteomic expression profile (see, e.g., Tables 16 and 17) as compared to a reference plant (e.g., a reference *Glycine max* or agricultural grass plant).

Also provided herein are seed bacterial endophyte-enriched seedlings (e.g., *Glycine max* seedling), where the seedlings (or one or more tissue(s) from the seedling) have an endophyte population enriched to include 10% or more (e.g., 12% or more, 14% or more, 16% or more, 18% or more, 20% or more, 25% or more, 30% or more, 35% or more, 40% or more, 45% or more, or 50% or more) of a seed bacterial endophyte (e.g., any of the seed-origin bacterial endophytes described herein) that confer upon plants produced from the seedling at least one trait selected from the group consisting of: increased root biomass, increased root length, increased height, increased shoot length, increased leaf number, increased water use efficiency, increased overall biomass, increased photosynthesis rate, increased tolerance to drought, increased heat tolerance, increased salt tolerance, increased resistance to nematode stress, increased resistance to fungal pathogen, increased resistance to a bacterial pathogen, increased resistance to a viral pathogen, an increased level of one or more plant hormones, an increased level of a metabolite, or an altered proteomic expression profile (see, e.g., Tables 16 and 17), as compared to a reference plant (e.g., a reference *Glycine max* or agricultural grass plant).

Also provided herein are seed bacterial endophyte-enriched plants (e.g., agricultural plants such as *Glycine max* plants or agricultural grass plants), where the plants (or one or more tissue(s) from the plant) have an endophyte population enriched to include 10% or more (e.g., 12% or more, 14% or more, 16% or more, 18% or more, 20% or more, 25% or more, 30% or more, 35% or more, 40% or more, 45% or more, or 50% or more) of a seed bacterial endophyte entity (e.g., any of the seed bacterial endophytes described herein) that confer upon plants produced from the seedling at least one trait selected from the group consisting of: increased root biomass, increased root length, increased height, increased shoot length, increased leaf number, increased water use efficiency, increased overall biomass, increased photosynthesis rate, increased tolerance to drought, increased heat tolerance, increased salt tolerance, increased resistance to nematode stress, increased resistance to fungal pathogen, increased resistance to a bacterial pathogen, increased resistance to a viral pathogen, an increased level of one or more plant hormones, an increased level of a metabolite, or an altered proteomic expression profile (see, e.g., Tables 16 and 17), as compared to a reference plant (e.g., a reference *Glycine max* plant or agricultural grass plant).

The term "enriched" indicates the addition of a seed bacterial endophyte to a plant, seedling, or seed that does not have a detectable level of the seed bacterial endophyte in a naturally-occurring environment, and also indicates an increase in the amount or levels of the seed bacterial endophyte as compared to an untreated plant or a plant in a naturally-occurring environment. The endophyte population represents all the various endophytes present in a seed, a seedling (or one or more tissues in a seedling), or a plant (or one or more tissues in a plant).

Plants with Altered Proteomic Expression Profile

Also provided herein are plants (e.g., agricultural plants such as a *Glycine max*) plant or agricultural grass plant, wherein the plant is grown from a seed that has been contacted with a seed bacterial endophyte (e.g., any of the seed bacterial endophytes described herein), and the plant has an altered proteomic expression profile (as compared to reference plant derived from a seed that has not been contacted with the seed-origin bacterial endophyte) that includes an increase (e.g., at least 20%, at least 30%, at least 40%, at least 50%, at least 75%, at least 100%, at least 150%, or at least 200%) or decrease (e.g., at least 20%, at least 30%, at least 40%, at least 50%, or at least 75%) in the expression level of at least one (e.g., at least two, three, four, five, six, seven, eight, nine, ten, eleven, twelve, thirteen, fourteen, fifteen, and sixteen) proteins selected from the group consisting of: gi|356506190 Transketolase, chloroplastic and gi|356509275/Glutamate synthase [NADH], amyloplastic-like or gi|356506190/Transketolase, chloroplastic and gi|356516458/Staphylococcal nuclease domain-containing or gi|356506190/Transketolase, chloroplastic and gi|356533407/Embryonic protein DC-8-like or gi|356506190/Transketolase, chloroplastic and gi|356535993/Beta-conglycinin, alpha chain or gi|356506190/Transketolase, chloroplastic and gi|356575855/Beta-conglycinin, beta chain-like or gi|356506190/Transketolase, chloroplastic and gi|571477629/Low-temperature-induced 65 kDa prot. or gi|356509275/Glutamate synthase [NADH], amyloplastic-like and gi|356516458/Staphylococcal nuclease domain-containing or gi|356509275/Glutamate synthase [NADH], amyloplastic-like and gi|356533407/Embryonic protein DC-8-like or gi|356509275/Glutamate synthase [NADH], amyloplastic-like and gi|356535993/Beta-conglycinin, alpha chain or gi|356509275/Glutamate synthase [NADH], amyloplastic-like and gi|356575855/Beta-conglycinin, beta chain-like or gi|356509275/Glutamate synthase [NADH], amyloplastic-like and gi|571477629/Low-temperature-induced 65 kDa protein or gi|356533407/Embryonic protein DC-8-like and gi|356535993/Beta-conglycinin, alpha chain or gi|356533407/Embryonic protein DC-8-like and gi|356575855/Beta-conglycinin, beta chain-like or gi|356533407/Embryonic protein DC-8-like and gi|571477629/Low-temperature-induced 65 kDa prot. or gi|356575855/Beta-conglycinin, beta chain-like and gi|356535993/Beta-conglycinin, alpha chain or gi|571477629/Low-temperature-induced 65 kDa prot. and gi|356535993/Beta-conglycinin, alpha chain or gi|571477629/Low-temperature-induced 65 kDa prot. and gi|356575855/Beta-conglycinin, beta chain-like.

Also provided are seeds (e.g., agricultural plant seeds such as a *Glycine max* seed or an agricultural grass plant seed), wherein the seed has been contacted with a seed bacterial endophyte (e.g., any of the seed bacterial endophytes described herein), and the seed has an altered proteomic expression profile (as compared to reference seed that has not been contacted with the seed bacterial endophyte) that includes an increase (e.g., at least 20%, at least 30%, at least 40%, at least 50%, at least 75%, at least 100%, at least 150%, or at least 200%) or decrease (e.g., at least 20%, at least 30%, at least 40%, at least 50%, or at least 75%) in the expression level of at least one (e.g., at least two, three, four, five, six, seven, eight, nine, ten, eleven, twelve, thirteen, fourteen, fifteen, and sixteen) proteins selected from the group consisting of: gi|356506190 Transketolase, chloroplastic and gi|356509275/Glutamate synthase [NADH], amyloplastic-like or gi|356506190/Transketolase, chloroplastic and gi|356516458/Staphylococcal nuclease domain-containing or gi|356506190/Transketolase, chloroplastic and gi|356533407/Embryonic protein DC-8-like or gi|356506190/Transketolase, chloroplastic and gi|356535993/Beta-conglycinin, alpha chain or gi|356506190/Transketolase, chloroplastic and gi|356575855/Beta-conglycinin, beta chain-like or gi|356506190/Transketolase, chloroplastic and gi|571477629/Low-temperature-induced 65 kDa prot. or gi|356509275/Glutamate synthase [NADH], amyloplastic-like and gi|356516458/Staphylococcal nuclease domain-containing or gi|356509275/Glutamate synthase [NADH], amyloplastic-like and gi|356533407/Embryonic protein DC-8-like or gi|356509275/Glutamate synthase [NADH], amyloplastic-like and gi|356535993/Beta-conglycinin, alpha chain or gi|356509275/Glutamate synthase [NADH], amyloplastic-like and gi|356575855/Beta-conglycinin, beta chain-like or gi|356509275/Glutamate synthase [NADH], amyloplastic-like and gi|571477629/Low-temperature-induced 65 kDa protein or gi|356533407/Embryonic protein DC-8-like and gi|356535993/Beta-conglycinin, alpha chain or gi|356533407/Embryonic protein DC-8-like and gi|356575855/Beta-conglycinin, beta chain-like or gi|356533407/Embryonic protein DC-8-like and gi|571477629/Low-temperature-induced 65 kDa prot. or gi|356575855/Beta-conglycinin, beta chain-like and gi|356535993/Beta-conglycinin, alpha chain or gi|571477629/Low-temperature-induced 65 kDa prot. and gi|356535993/Beta-conglycinin, alpha chain or gi|571477629/Low-temperature-induced 65 kDa prot. and gi|356575855/Beta-conglycinin, beta chain-like.

Also provided herein are seedlings (e.g., an agricultural plant seedlings such as a *Glycine max* seedling or agricultural grass plant seedling), wherein the seedling is grown from a seed that has been contacted with a seed bacterial endophyte (e.g., any of the seed bacterial endophytes described herein), and the seedling has an altered proteomic expression profile (as compared to reference seedling derived from a seed that has not been contacted with the seed bacterial endophyte) that includes an increase (e.g., at least 20%, at least 30%, at least 40%, at least 50%, at least 75%, at least 100%, at least 150%, or at least 200%) or decrease (e.g., at least 20%, at least 30%, at least 40%, at least 50%, or at least 75%) in the expression level of at least one (e.g., at least two, three, four, five, six, seven, eight, nine, ten, eleven, twelve, thirteen, fourteen, fifteen, and sixteen) proteins selected from the group consisting of: gi|356506190 Transketolase, chloroplastic and gi|356509275/Glutamate synthase [NADH], amyloplastic-like or gi|356506190/Transketolase, chloroplastic and gi|356516458/Staphylococcal nuclease domain-containing or gi|356506190/Transketolase, chloroplastic and gi|356533407/Embryonic protein DC-8-like or gi|356506190/Transketolase, chloroplastic and gi|356535993/Beta-conglycinin, alpha chain or gi|356506190/Transketolase, chloroplastic and gi|356575855/Beta-conglycinin, beta chain-like or gi|356506190/Transketolase, chloroplastic and gi|571477629/Low-temperature-induced 65 kDa prot. or gi|356509275/Glutamate synthase [NADH], amyloplastic-like and gi|356516458/Staphylococcal nuclease domain-containing or gi|356509275/Glutamate synthase [NADH], amyloplastic-like and gi|356533407/Embryonic protein DC-8-like or gi|356509275/Glutamate synthase [NADH], amyloplastic-like and gi|356535993/Beta-conglycinin, alpha chain or gi|356509275/Glutamate synthase [NADH], amyloplastic-like and gi|356575855/Beta-conglycinin, beta chain-like or gi|356509275/Glutamate synthase [NADH], amyloplastic-like and gi|571477629/Low-temperature-induced 65 kDa protein or gi|356533407/Embryonic protein DC-8-like and gi|356535993/Beta-conglycinin, alpha chain or gi|356533407/Embryonic protein DC-8-like and gi|356575855/Beta-conglycinin, beta chain-like or gi|356533407/Embryonic protein DC-8-like and gi|571477629/Low-temperature-induced 65 kDa prot. or gi|356575855/Beta-conglycinin, beta chain-like and gi|356535993/Beta-conglycinin, alpha chain or gi|571477629/Low-temperature-induced 65 kDa prot. and gi|356535993/Beta-conglycinin, alpha chain or gi|571477629/Low-temperature-induced 65 kDa protein and gi|356575855/Beta-conglycinin, beta chain-like.

Methods for performing proteomic analysis and determining a proteomic expression profile are well known in the art. Non-limiting methods of performing proteomic analysis are described in the art and include two-dimensional electrophoresis and mass spectrometry, protein chips, and reverse phased protein microarray. Additional methods for performing proteomic analysis are described in Katrin Marcus, Quantitative Methods in Proteomics, Humana Press, 2012, Population of Seeds In another aspect, the invention provides for a substantially uniform population of seeds including a plurality of seeds including the bacterial endophytic population, as described herein above. Substantial uniformity can be determined in many ways. In some cases, at least 10%, for example, at least 20%, at least 30%, at least 40%, at least 50%, at least 60%, at least 70%, at least 75%, at least 80%, at least 90%, at least 95% or more of the seeds in the population, contains the bacterial endophytic population in an amount effective to colonize the plant disposed on the surface of the seeds. In other cases, at least 10%, for example, at least 20%, at least 30%, at least 40%, at least 50%, at least 60%, at least 70%, at least 75%, at least 80%, at least 90%, at least 95% or more of the seeds in the population, contains at least 1, 10, or 100 CFU on the seed surface or per gram of seed, for example, at least 200 CFU, at least 300 CFU, at least 1,000 CFU, at least 3,000 CFU, at least 10,000 CFU, at least 30,000 CFU, at least 100,000 CFU, at least 300,000 CFU, or at least 1,000,000 CFU per seed or more.

In a particular embodiment, the population of seeds is packaged in a bag or container suitable for commercial sale. Bag packaging systems can be obtained, for example, from Premier Tech Chronos (www.ptchronos.com) and bulk seed packaging systems such as PROBOX® can be obtained, for example, from Buckhorn Inc. (Akron, Ohio). Typically such a bag or container contains a unit weight or count of the seeds including the bacterial endophytic population as described herein, and further comprises a label. In one embodiment, the bag or container contains at least 1,000 seeds, for example, at least 5,000 seeds, at least 10,000 seeds, at least 20,000 seeds, at least 30,000 seeds, at least 50,000 seeds, at least 70,000 seeds, at least 80,000 seeds, at least 90,000 seeds or more. In another embodiment, the bag or container can comprise a discrete weight of seeds, for example, at least 1 lb, at least 2 lbs, at least 5 lbs, at least 10 lbs, at least 30 lbs, at least 50 lbs, at least 70 lbs or more. In the case of soybean, seeds can be packaged in packaging material by seed count, e.g., 140,000 seeds per bag, or by weight, e.g., 50 lbs. of seed per bag. Soybeans can also be packaged by seed count or seed weight in mini-bulk boxes or in bulk boxes, e.g., 5.6 million seeds per box.

A bag or container can include a label describing the seeds and/or said bacterial endophytic population. The label can contain additional information, for example, the information selected from the group consisting of: net weight, lot number, geographic origin of the seeds, test date, germination rate, inert matter content, and the amount of noxious weeds, if any. Suitable containers or packages include those traditionally used in plant seed commercialization. The invention also contemplates other containers with more sophisticated storage capabilities (e.g., with microbiologically tight wrappings or with gas- or water-proof containments).

In some cases, a sub-population of seeds including the bacterial endophytic population is further selected on the basis of increased uniformity, for example, on the basis of uniformity of microbial population. For example, individual seeds of pools collected from individual cobs, individual plants, individual plots (representing plants inoculated on the same day) or individual fields can be tested for uniformity of microbial density, and only those pools meeting specifications (e.g., at least 80% of tested seeds have minimum density, as determined by quantitative methods described elsewhere) are combined to provide the agricultural seed sub-population.

The methods described herein can also comprise a validating step. The validating step can entail, for example, growing some seeds collected from the inoculated plants into mature agricultural plants, and testing those individual plants for uniformity. Such validating step can be performed on individual seeds collected from cobs, individual plants, individual plots (representing plants inoculated on the same day) or individual fields, and tested as described above to identify pools meeting the required specifications.

In some embodiments, methods described herein include planting a synthetic combination described herein. Suitable planters include an air seeder and/or fertilizer apparatus used in agricultural operations to apply particulate materials including one or more of the following, seed, fertilizer and/or inoculants, into soil during the planting operation. Seeder/fertilizer devices can include a tool bar having ground-engaging openers thereon, behind which is towed a wheeled cart that includes one or more containment tanks or bins and associated metering means to respectively contain and meter therefrom particulate materials. See, e.g., U.S. Pat. No. 7,555,990.

In certain embodiments, a composition described herein may be in the form of a liquid, a slurry, a solid, or a powder (wettable powder or dry powder). In another embodiment, a composition may be in the form of a seed coating. Compositions in liquid, slurry, or powder (e.g., wettable powder) form may be suitable for coating seeds. When used to coat seeds, the composition may be applied to the seeds and allowed to dry. In embodiments wherein the composition is a powder (e.g., a wettable powder), a liquid, such as water, may need to be added to the powder before application to a seed.

In still another embodiment, the methods can include introducing into the soil an inoculum of one or more of the endophyte populations described herein. Such methods can include introducing into the soil one or more of the compositions described herein. The inoculum(s) or compositions may be introduced into the soil according to methods known to those skilled in the art. Non-limiting examples include in-furrow introduction, spraying, coating seeds, foliar introduction, etc. In a particular embodiment, the introducing step comprises in-furrow introduction of the inoculum or compositions described herein.

In one embodiment, seeds may be treated with composition(s) described herein in several ways but preferably via spraying or dripping. Spray and drip treatment may be conducted by formulating compositions described herein and spraying or dripping the composition(s) onto a seed(s) via a continuous treating system (which is calibrated to apply treatment at a predefined rate in proportion to the continuous flow of seed), such as a drum-type of treater. Batch systems, in which a predetermined batch size of seed and composition(s) as described herein are delivered into a mixer, may also be employed. Systems and apparati for performing these processes are commercially available from numerous suppliers, e.g., Bayer CropScience (Gustafson).

In another embodiment, the treatment entails coating seeds. One such process involves coating the inside wall of a round container with the composition(s) described herein, adding seeds, then rotating the container to cause the seeds to contact the wall and the composition(s), a process known in the art as "container coating". Seeds can be coated by combinations of coating methods. Soaking typically entails using liquid forms of the compositions described. For example, seeds can be soaked for about 1 minute to about 24 hours (e.g., for at least 1 min, 5 min, 10 min, 20 min, 40 min, 80 min, 3 hr, 6 hr, 12 hr, 24 hr).

Population of Plants/Agricultural Fields

A major focus of crop improvement efforts has been to select varieties with traits that give, in addition to the highest return, the greatest homogeneity and uniformity. While inbreeding can yield plants with substantial genetic identity, heterogeneity with respect to plant height, flowering time, and time to seed, remain impediments to obtaining a homogeneous field of plants. The inevitable plant-to-plant variability are caused by a multitude of factors, including uneven environmental conditions and management practices. Another possible source of variability can, in some cases, be due to the heterogeneity of the microbial population inhabit the plants. By providing bacterial endophytic populations onto seeds and seedlings, the resulting plants generated by germinating the seeds and seedlings have a more consistent microbial composition, and thus are expected to yield a more uniform population of plants.

Therefore, in another aspect, the invention provides a substantially uniform population of plants. The population can include at least 100 plants, for example, at least 300 plants, at least 1,000 plants, at least 3,000 plants, at least 10,000 plants, at least 30,000 plants, at least 100,000 plants or more. The plants are grown from the seeds including the bacterial endophytic population as described herein. The increased uniformity of the plants can be measured in a number of different ways.

In one embodiment, there is an increased uniformity with respect to the microbes within the plant population. For example, in one embodiment, a substantial portion of the population of plants, for example at least 10%, at least 20%, at least 30%, at least 40%, at least 50%, at least 60%, at least 70%, at least 75%, at least 80%, at least 90%, at least 95% or more of the seeds or plants in a population, contains a threshold number of the bacterial endophytic population. The threshold number can be at least 10 CFU, at least 100 CFU, for example at least 300 CFU, at least 1,000 CFU, at least 3,000 CFU, at least 10,000 CFU, at least 30,000 CFU, at least 100,000 CFU or more, in the plant or a part of the plant. Alternatively, in a substantial portion of the population of plants, for example, in at least 1%, at least 10%, at least 20%, at least 30%, at least 40%, at least 50%, at least 60%, at least 70%, at least 75%, at least 80%, at least 90%, at least 95% or more of the plants in the population, the bacterial endophyte population that is provided to the seed or seedling represents at least 0.1%, at least 1%, at least 5%, at least 10%, at least 20%, at least 30%, at least 40%, at least 50%, at least 60%, at least 70%, at least 80%, at least 90%, at least 95%, at least 99%, or 100% of the total microbe population in the plant/seed.

In one embodiment, there is increased genetic uniformity of a substantial proportion or all detectable microbes within the taxa, genus, or species of the seed microbe relative to an uninoculated control. This increased uniformity can be a result of the seed microbe being of monoclonal origin or otherwise deriving from a seed microbial population including a more uniform genome sequence and plasmid repertoire than would be present in the microbial population a plant that derives its microbial community largely via assimilation of diverse soil symbionts. The uniformity In another embodiment, there is an increased uniformity with respect to a physiological parameter of the plants within the population. In some cases, there can be an increased uniformity in the height of the plants when compared with a population of reference agricultural plants grown under the same conditions. For example, there can be a reduction in the standard deviation in the height of the plants in the population of at least 5%, for example, at least 10%, at least 15%, at least 20%, at least 30%, at least 40%, at least 50%, at least 60% or more, when compared with a population of reference agricultural plants grown under the same conditions. In other cases, there can be a reduction in the standard deviation in the flowering time of the plants in the population of at least 5%, for example, at least 10%, at least 15%, at least 20%, at least 30%, at least 40%, at least 50%, at least 60% or more, when compared with a population of reference agricultural plants grown under the same conditions.

Commodity Plant Product

The present invention provides a commodity plant product, as well as methods for producing a commodity plant product, that is derived from a plant of the present invention. As used herein, a "commodity plant product" refers to any composition or product that is comprised of material derived from a plant, seed, plant cell, or plant part of the present invention. Commodity plant products may be sold to consumers and can be viable or nonviable. Nonviable commodity products include but are not limited to nonviable seeds and grains; processed seeds, seed parts, and plant parts; dehydrated plant tissue, frozen plant tissue, and processed plant tissue; seeds and plant parts processed for animal feed for terrestrial and/or aquatic animal consumption, oil, meal, flour, flakes, bran, fiber, paper, tea, coffee, silage, crushed of whole grain, and any other food for human or animal consumption; and biomasses and fuel products; and raw material in industry. Industrial uses of oils derived from the agricultural plants described herein include ingredients for paints, plastics, fibers, detergents, cosmetics, lubricants, and biodiesel fuel. Soybean oil may be split, inter-esterified, sulfurized, epoxidized, polymerized, ethoxylated, or cleaved. Designing and producing soybean oil derivatives with improved functionality and improved oliochemistry is a rapidly growing field. The typical mixture of triglycerides is usually split and separated into pure fatty acids, which are then combined with petroleum-derived alcohols or acids, nitrogen, sulfonates, chlorine, or with fatty alcohols derived from fats and oils to produce the desired type of oil or fat. Commodity plant products also include industrial compounds, such as a wide variety of resins used in the formulation of adhesives, films, plastics, paints, coatings and foams.

The invention will be further described in the following examples, which do not limit the scope of the invention described in the claims.

EXAMPLES

Example 1—Isolation of Bacterial Endophytes from Seeds, Seedlings, and Plants

In order to better understand the role played by seed-borne endophytic microbes in improving the vigor, general health and stress resilience of host plants, a systematic screen was initiated to isolate and characterize endophytic microbes from seeds of commercially significant grass plants.

Diverse types of maize, wheat, rice, and other seeds were acquired and screened for cultivatable microbes. Forty nine distinct cultivars of maize and teosinte accessions were sourced from the USDA via GRIN (National Genetic Resources Program at ars-grin.gov/) or purchased from the Sustainable Seed Company (Covelo, Calif.). Similarly, 5 distinct wheat cultivars and wheat relatives were sourced from the USDA via GRIN (National Genetic Resources Program at ars-grin.gov/) or purchased from a Whole Foods in Cambridge, Mass. Seeds of rice and rice relatives (23 in total) were sourced from the USDA via GRIN (National Genetic Resources Program at http://www.ars-grin.gov/) or purchased from a Whole Foods in Cambridge, Mass. Seeds of several other species of plants, including sorghum, millet, oat, rye, teff, etc., were sourced from the USDA via GRIN (National Genetic Resources Program at ars-grin.gov/), the Sustainable Seed Company or purchased from a Whole Foods in Cambridge, Mass.

Pools of 5 seeds were soaked in 10 mL of sterile water contained in sterile 15 mL conical tubes for 24 hours. Some maize and rice accessions were sampled for seed surface microbes. In these cases, after 24 hours of soaking, 50 µL aliquots of undiluted, 100× dilute and 10000× dilute soaking water was plated onto Reasoner's 2A agar [R2A; proteose peptone (0.5 g L$^{-1}$), casamino acids (0.5 g L$^{-1}$), yeast extract (0.5 g L$^{-1}$), dextrose (0.5 g L$^{-1}$) soluble starch (0.5 g L$^{-1}$), dipotassium phosphate (0.3 g L$^{-1}$), magnesium sulfate 7H$_2$O (0.05 g L$^{-1}$), sodium pyruvate (0.3 g L$^{-1}$), agar (15 g L$^{-1}$), final pH 7±0.2 @ 25° C.] to culture oligotrophic bacteria, while the same volumes and dilutions were also plated onto potato dextrose agar [PDA; potato infusion from 200 g L$^{-1}$, dextrose 20 g L$^{-1}$, agar 15 g L$^{-1}$, final pH: 5.6±0.2 at 25° C.] to culture copiotrophic bacteria and fungi. All seeds in the study were sampled for endophytes by surface sterilization, trituration, and culturing of the tissue homogenate. Seeds were surface sterilized by washing with 70% EtOH, rinsing with water, then washing with a 3% solution of sodium hypochlorite followed by 3 rinses in sterile water. All wash and rinse steps lasted 5 minutes with constant shaking at 130 rpm. Seeds were then blotted on R2A agar which was incubated at 30° C. for 7 days in order to confirm successful surface sterilization. Following the surface sterilization process, batches of seeds were ground with a sterile mortar and pestle in sterile R2A broth, while seeds of maize, rice and soy were also grown in sterile conditions and the roots or shoots of seedlings (without further sterilization) were crushed by bead beating in a Fastprep24 machine with 3 carbide beads, 1 mL of R2A broth in a 15 ml, Falcon tube shaking at 6M s$^{-1}$ for 60 seconds. Extracts of surface washes, crushed seed, or macerated seedling tissue were serially diluted by factors of 1 to 10$^{-3}$ and spread onto quadrants on R2A, PDA, LGI or V8 juice agar in order to isolate cultivable seed-borne microorganisms. Plates were incubated at 28° C. for 7 days, monitoring for the appearance of colonies daily. After a week, plates were photographed and different morphotypes of colonies were identified and labeled. These were then selected for identification by sequencing, archiving at −80° C. as glycerol stock, and assaying for beneficial functions as described herein.

Plating and Scoring of Microbes

After 7 days of growth, most bacterial colonies had grown large and distinct enough to allow differentiation based on colony size, shape, color and texture.

Photographs of each plate were taken, and on the basis of color and morphotype, different colonies were identified by number for later reference. These isolates were also streaked out onto either R2A or PDA to check for purity, and clean cultures were then scraped with a loop off the plate, resuspended in a mixture of R2A and glycerol, and stored in quadruplicate at −80° C.

Example 2—Sequence Analysis & Phylogenetic Assignment

To accurately characterize the isolated bacterial endophytes, colonies were submitted for marker gene sequencing, and the sequences were analyzed to provide taxonomic classifications. Colonies were subjected to 16S rRNA gene PCR amplification using a 27f/1492r primer set, and Sanger sequencing of paired ends was performed at Genewiz (South Plainfield, N.J.). Raw chromatograms were converted to sequences, and corresponding quality scores were assigned using TraceTuner v3.0.6beta (U.S. Pat. No. 6,681,186, incorporated herein by reference). These sequences were quality filtered using PRINSEQ v0.20.3 (Schmieder and Edwards 2011, Bioinformatics 2011, 27(6):863-864) with left and right trim quality score thresholds of 30 and a quality window of 20 bp. Paired end quality filtered sequences were merged using USEARCH v7.0 (Edgar Nature Methods 2013, 10(10):996-8). Taxonomic classifications were assigned to the sequences using the RDP classifier (Wang et al. 2007, 73(16):5261-7) trained on the Greengenes database (McDonald et al. 2012, ISME Journal 6(3):610-618)). The resulting 473 microbes, representing 44 distinct OTUs (using a 97% similarity threshold) are provided in Table 2.

Example 3—In-Vitro Testing of Bacterial Endophytes

A total of 242 seed bacterial endophytes representing 44 distinct OTUs as described above were seeded onto 96 well plates and tested for various activities and/or production of compounds, as described below. Colonies or wells with no detectable activity were scored as "−", low activity as "1," moderate activity as "2" and strong activity as "3." The results of these in vitro assays are summarized in Table 3.

Production of Auxin (SD)

To allow for growth and the accumulation of auxin, bacterial isolates were inoculated into 250 µL R2A broth supplemented with L-tryptophan (5 mM) in 350 μL, transparent flat bottom, 96 well culture plates. The plates were sealed with a breathable membrane and incubated at 28° C. under static conditions for 3 days. After 3 days the OD600 and OD530 nm were measured on a plate reader to check for bacterial growth. After measuring these ODs, 50 μL of yellowish Salkowski reagent (0.01 M FeCl3 in 35% HClO$_4$ (perchloric acid, #311421, Sigma) were added to each well and incubated in the dark for 30 minutes before measuring the OD530 nm measured to detect pink/red color.

Auxin is an important plant hormone, which can promote cell enlargement and inhibit branch development (meristem activity) in above ground plant tissues, while below ground it has the opposite effect, promoting root branching and growth. Interestingly, plant auxin is manufactured above ground and transported to the roots. It thus follows that plant and especially root inhabiting microbes which produce significant amounts of auxin will be able to promote root branching and development even under conditions where the plant reduces its own production of auxin. Such conditions can exist for example when soil is flooded and roots encounter an anoxic environment which slows or stops root metabolism.

Seed bacteria were screened for their ability to produce auxins as possible root growth promoting agents. A very large number of bacteria, 169 out of 247, showed a detectable level of pink or red color development (the diagnostic feature of the assay for auxin or indolic compound production). 89 isolates had particularly strong production of auxin or indole compounds. *Erwinia* and *Pantoea* species are very similar if not identical taxonomic groups and can thus be considered together. Of a total of 38 isolates, 23 had moderate or strong production of auxin or indole compounds in vitro. As many of the bacteria from the *Erwinia* and *Pantoea* genera were isolated from inside surface sterilized seeds, our results indicate their ability to heterologously colonize the inside of the emerging radicle (first plant part to emerge the seed) in order to stimulate root growth by producing auxins inside the new plant host.

Another important group of auxin producing seed bacteria was the *Pseudomonas* genus, where 9 of the 14 species isolated showed significant production of indoles in this assay. *Ochrobactrum* species were also detected as strong producers of indolic compounds in this assay, with 15 of 18 showing moderate to strong color change (although all 18 had detectable color change in this assay). Strongly auxin producing isolates of *Pseudomonas* and *Ochrobactrum* species were isolated from seed surfaces.

Mineral Phosphate Solubilization

Microbes were plated on tricalcium phosphate media was prepared as follows: 10 g L$^{-1}$ glucose, 0.373 g L$^{-1}$NH$_4$NO$_3$, 0.41 g L$^{-1}$MgSO$_4$, 0.295 g L$^{-1}$ NaCl, 0.003 g L$^{-1}$ FeCl$_3$, 0.7 g L$^{-1}$ Ca$_3$HPO$_4$, 100 mM Tris and 20 g L$^{-1}$ agar, pH 7 (Rodriguez et al. 2001, J Biotechnol 84(2): 155-16), then autoclaved and poured into square Petri plates. After 3 days of growth at 28° C. in darkness, clear halos were measured around colonies able to solubilize the tricalcium phosphate. This was an agar based assay looking for halos around colonies which signify the solubilization of opaque tricalcium phosphate, which resulted in a large number (95) of isolates having detectable levels of phosphate solubilization (Table 3). Of these, at least 36 had moderate to high levels of phosphate solubilization, including several *Enterobacter* and *Pantoea* isolates.

Growth on Nitrogen Free LGI Media

All glassware was cleaned with 6 M HCl before media preparation. A new 96 well plate (300 ul well volume) was filled with 250 ul well$^{-1}$ of sterile LGI broth [per L, 50 g sucrose, 0.01 g FeCl$_3$-6H$_2$O, 0.8 g K$_3$PO$_4$, 0.2 g CaCl2, 0.2 g MgSO$_4$-7H$_2$O, 0.002 g Na$_2$MoO$_4$-2H$_2$O, pH 7.5]. Bacteria were inoculated into the 96 wells simultaneously with a flame-sterilized 96 pin replicator. The plate was sealed with a breathable membrane, incubated at 28° C. without shaking for 5 days, and OD600 readings taken with a 96 well plate reader.

A nitrogen-fixing plant-associated bacterium is able theoretically to add to the host's nitrogen metabolism, and the most well studied beneficial plant-associated bacteria, *rhizobia*, are able to do this within specially adapted organs on the roots of leguminous plants. The seed-associated bacteria in this study may be able to fix nitrogen in association with the developing seedling, whether they colonize the plant's surfaces or interior and thereby add to the plant's nitrogen nutrition.

In total, of the 247 isolates there were 34 (14%) which had detectable growth under nitrogen limiting conditions (Table 4) and were represented by specific taxonomic groups (Table 3). All of these groups are known to have representatives with the potential to fix atmospheric nitrogen; however chief among these were *Bacillus, Burkholderia, Enterobacter, Methylobacteria*, and *Pseudomonas* (Table 4).

TABLE 3

Functional assays to examine the potential for seed microbes to confer novel functions to crops.

| SYM # | OTU | SEQ | Taxonomy | Antagonizes E. coli | Antagonizes S. cerevisciae | Shows Cellulolytic activity | Shows Pectinolytic activity |
|---|---|---|---|---|---|---|---|
| SYM00033 | 0 | 541 | Enterobacter sp. | — | — | 1 | 1 |
| SYM00173 | 0 | 593 | Pantoea sp. | 2 | — | 1 | 1 |
| SYM00176 | 0 | 596 | Pantoea sp. | 1 | — | 1 | 1 |
| SYM00605 | 0 | 716 | | — | — | 1 | 1 |
| SYM00607 | 0 | 717 | | — | — | — | — |
| SYM00608 | 0 | 718 | Pantoea sp. | — | — | — | — |
| SYM00620 | 0 | 720 | Enterobacter sp. | — | 1 | 1 | 1 |
| SYM00658 | 0 | 736 | | 1 | 1 | 1 | 1 |
| SYM00660 | 1 | 737 | Pseudomonas sp. | — | 1 | 2 | 2 |
| SYM00011 | 2 | 522 | Pseudomonas sp. | — | — | — | — |
| SYM00011b | 2 | 523 | Pseudomonas sp. | — | — | — | — |
| SYM00013 | 2 | 524 | Pseudomonas sp. | — | — | 2 | 2 |
| SYM00014 | 2 | 526 | Pseudomonas sp. | — | — | 2 | 2 |
| SYM00062 | 2 | 557 | Pseudomonas sp. | — | — | 2 | 2 |
| SYM00068 | 2 | 563 | Pseudomonas sp. | — | — | 2 | 2 |

TABLE 3-continued

Functional assays to examine the potential for seed microbes to confer novel functions to crops.

| | | | | | | | |
|---|---|---|---|---|---|---|---|
| SYM00069 | 2 | 564 | Pseudomonas sp. | — | — | — | — |
| SYM00646 | 2 | 730 | Pseudomonas sp. | — | — | 2 | 2 |
| SYM00649 | 2 | 733 | Pseudomonas sp. | — | — | 2 | 2 |
| SYM00650 | 2 | 734 | Pseudomonas sp. | — | 1 | 2 | 2 |
| SYM00657 | 2 | 735 | Pseudomonas sp. | — | — | 2 | 2 |
| SYM00672 | 2 | 738 | Pseudomonas sp. | — | — | 2 | 2 |
| SYM00709 | 2 | 747 | Pseudomonas sp. | — | — | 3 | 3 |
| SYM00013b | 3 | 525 | Curtobacterium sp. | — | — | — | — |
| SYM00167 | 3 | 588 | Curtobacterium sp. | — | — | — | — |
| SYM00171 | 3 | 591 | Curtobacterium sp. | — | — | — | — |
| SYM00174 | 3 | 594 | Curtobacterium sp. | — | — | — | — |
| SYM00178 | 3 | 598 | Curtobacterium sp. | — | — | 1 | 1 |
| SYM00180 | 3 | 600 | Curtobacterium sp. | — | — | — | — |
| SYM00181 | 3 | 601 | Curtobacterium sp. | — | — | — | — |
| SYM00235 | 3 | 622 | Curtobacterium sp. | — | — | 1 | 1 |
| SYM00244 | 3 | 626 | Curtobacterium sp. | — | — | 1 | 1 |
| SYM00525 | 3 | 654 | Curtobacterium sp. | — | — | — | — |
| SYM00625 | 3 | 724 | Curtobacterium sp. | — | — | 2 | 2 |
| SYM00645 | 3 | 729 | Curtobacterium sp. | — | — | — | — |
| SYM00647 | 3 | 731 | Curtobacterium sp. | — | — | 1 | 1 |
| SYM00690 | 3 | 740 | Curtobacterium sp. | — | — | — | — |
| SYM00691 | 3 | 741 | Curtobacterium sp. | — | — | — | — |
| SYM00693 | 3 | 742 | Curtobacterium sp. | — | — | 1 | 1 |
| SYM00712 | 3 | 748 | Curtobacterium sp. | — | — | 1 | 1 |
| SYM00716 | 3 | 752 | Curtobacterium sp. | — | — | — | — |
| SYM00722 | 3 | 753 | Curtobacterium sp. | — | — | 1 | 1 |
| SYM00731b | 3 | 756 | Curtobacterium sp. | — | — | — | — |
| SYM00784 | 3 | 773 | Curtobacterium sp. | 2 | — | — | — |
| SYM00188 | 6 | 605 | Paenibacillus sp. | — | — | — | — |
| SYM00190 | 6 | 607 | Paenibacillus sp. | — | — | 1 | 1 |
| SYM00195 | 6 | 610 | Paenibacillus sp. | — | — | — | — |
| SYM00217 | 6 | 616 | Paenibacillus sp. | — | — | — | — |
| SYM00227 | 6 | 619 | Paenibacillus sp. | — | — | 1 | 1 |
| SYM00597 | 6 | 711 | Paenibacillus sp. | — | — | — | — |
| SYM00017b | 7 | 532 | Pantoea sp. | — | — | 1 | 1 |
| SYM00018 | 7 | 534 | Pantoea sp. | — | — | — | — |
| SYM00020 | 7 | 535 | Pantoea sp. | — | — | — | — |
| SYM00022 | 7 | 537 | Pantoea sp. | — | — | 1 | 1 |
| SYM00025 | 7 | 538 | Pantoea sp. | — | — | 1 | 1 |
| SYM00043 | 7 | 544 | Pantoea sp. | — | — | 1 | 1 |
| SYM00047 | 7 | 546 | Pantoea sp. | — | — | 1 | 1 |
| SYM00049 | 7 | 547 | Pantoea sp. | — | — | — | — |
| SYM00055 | 7 | 553 | Pantoea sp. | — | — | 1 | 1 |
| SYM00057 | 7 | 554 | Pantoea sp. | — | — | — | — |
| SYM00058 | 7 | 555 | Pantoea sp. | — | — | — | — |
| SYM00078 | 7 | 568 | Pantoea sp. | 3 | 1 | 1 | 1 |
| SYM00081 | 7 | 569 | Pantoea sp. | — | — | 1 | 1 |
| SYM00082a | 7 | 570 | Pantoea sp. | — | — | — | — |
| SYM00085 | 7 | 571 | Pantoea sp. | — | — | 1 | 1 |
| SYM00086 | 7 | 572 | Pantoea sp. | — | — | 1 | 1 |
| SYM00088 | 7 | 574 | Pantoea sp. | — | — | — | — |
| SYM00094 | 7 | 576 | Pantoea sp. | — | — | 1 | 1 |
| SYM00095 | 7 | 577 | Pantoea sp. | — | — | 1 | 1 |
| SYM00096 | 7 | 578 | Pantoea sp. | — | — | 1 | 1 |
| SYM00100 | 7 | 579 | Pantoea sp. | 1 | 1 | 1 | 1 |
| SYM00101 | 7 | 580 | Pantoea sp. | — | — | — | — |
| SYM00502 | 7 | 639 | Erwinia sp. | — | — | — | — |
| SYM00506 | 7 | 641 | Erwinia sp. | — | — | 1 | 1 |
| SYM00506b | 7 | 642 | Erwinia sp. | — | 1 | 1 | 1 |
| SYM00511 | 7 | 647 | Erwinia sp. | — | — | — | — |
| SYM00514b | 7 | 649 | Erwinia sp. | — | — | — | — |
| SYM00514c | 7 | 650 | Erwinia sp. | — | — | — | — |
| SYM00514d | 7 | 651 | Erwinia sp. | — | — | — | — |
| SYM00731a | 7 | 755 | Erwinia sp. | — | — | 1 | 1 |
| SYM00785 | 7 | 774 | Erwinia sp. | 1 | 1 | 1 | 1 |
| SYM00544 | 9 | 663 | Ochrobactrum sp. | — | 1 | — | — |
| SYM00545b | 9 | 665 | Ochrobactrum sp. | — | 1 | — | — |
| SYM00548 | 9 | 667 | Ochrobactrum sp. | — | 1 | — | — |
| SYM00552 | 9 | 670 | Ochrobactrum sp. | — | 1 | — | — |
| SYM00558 | 9 | 675 | Ochrobactrum sp. | — | 1 | — | — |
| SYM00580b | 9 | 689 | Ochrobactrum sp. | — | 1 | — | — |
| SYM00580d | 9 | 691 | Ochrobactrum sp. | — | 1 | — | — |
| SYM00583 | 9 | 699 | Ochrobactrum sp. | — | 1 | — | — |
| SYM00584 | 9 | 700 | Ochrobactrum sp. | — | — | — | — |
| SYM00588 | 9 | 705 | Ochrobactrum sp. | — | 1 | — | — |
| SYM00596 | 9 | 710 | Ochrobactrum sp. | — | 1 | — | — |
| SYM00600 | 9 | 713 | Ochrobactrum sp. | — | 1 | — | — |

TABLE 3-continued

Functional assays to examine the potential for seed microbes to confer novel functions to crops.

| | | | | | | | |
|---|---|---|---|---|---|---|---|
| SYM00746 | 9 | 757 | *Ochrobactrum* sp. | 1 | 1 | — | — |
| SYM00752 | 9 | 759 | *Ochrobactrum* sp. | 1 | 1 | — | — |
| SYM00756 | 9 | 761 | *Ochrobactrum* sp. | 1 | — | — | — |
| SYM00763 | 9 | 767 | *Ochrobactrum* sp. | 1 | — | — | — |
| SYM00783 | 9 | 772 | *Ochrobactrum* sp. | 1 | 1 | — | — |
| SYM00812 | 9 | 775 | *Ochrobactrum* sp. | — | — | — | — |
| SYM00064a | 10 | 560 | *Stenotrophomonas* sp. | — | — | — | — |
| SYM00183 | 10 | 603 | *Stenotrophomonas* sp. | — | — | — | — |
| SYM00184 | 10 | 604 | *Stenotrophomonas* sp. | — | — | — | — |
| SYM00543 | 12 | 662 | *Bacillus* sp. | 1 | 1 | — | — |
| SYM00595 | 12 | 709 | *Bacillus* sp. | 1 | 1 | — | — |
| SYM00580c | 13 | 690 | *Achromobacter* sp. | — | — | — | — |
| SYM00547 | 13 | 666 | *Achromobacter* sp. | — | — | — | — |
| SYM00551 | 13 | 669 | *Achromobacter* sp. | — | 1 | — | — |
| SYM00560 | 13 | 676 | *Achromobacter* sp. | — | — | — | — |
| SYM00565b | 13 | 681 | *Achromobacter* sp. | — | — | — | — |
| SYM00580i | 13 | 694 | *Achromobacter* sp. | — | 1 | — | — |
| SYM00585 | 13 | 701 | *Achromobacter* sp. | — | — | — | — |
| SYM00586b | 13 | 702 | *Achromobacter* sp. | — | 1 | — | — |
| SYM00588b | 13 | 706 | *Achromobacter* sp. | — | — | — | — |
| SYM00591 | 13 | 708 | *Achromobacter* sp. | — | — | — | — |
| SYM00602 | 13 | 715 | *Achromobacter* sp. | — | — | — | — |
| SYM00758 | 13 | 763 | *Achromobacter* sp. | — | — | — | — |
| SYM00761 | 13 | 765 | *Achromobacter* sp. | — | — | — | — |
| SYM00764 | 13 | 768 | *Achromobacter* sp. | — | — | — | — |
| SYM00765 | 13 | 769 | *Achromobacter* sp. | — | — | — | — |
| SYM00824 | 13 | 777 | *Achromobacter* sp. | — | 1 | — | — |
| SYM00828 | 13 | 778 | *Achromobacter* sp. | — | — | — | — |
| SYM00830 | 13 | 779 | *Achromobacter* sp. | — | — | — | — |
| SYM00831 | 13 | 780 | *Achromobacter* sp. | — | — | — | — |
| SYM00028 | 18 | 540 | *Enterobacter* sp. | 1 | 1 | 1 | 1 |
| SYM00052 | 18 | 550 | *Enterobacter* sp. | — | — | 1 | 1 |
| SYM00053 | 18 | 551 | *Enterobacter* sp. | — | — | 1 | 1 |
| SYM00054 | 18 | 552 | *Enterobacter* sp. | — | — | — | — |
| SYM00175 | 18 | 595 | *Enterobacter* sp. | — | — | 1 | 1 |
| SYM00627 | 18 | 725 | *Enterobacter* sp. | 1 | 2 | 1 | 1 |
| SYM00715 | 18 | 751 | *Enterobacter* sp. | — | — | — | — |
| SYM00189 | 19 | 606 | *Bacillus* sp. | — | — | — | — |
| SYM00192 | 19 | 608 | *Bacillus* sp. | — | — | — | — |
| SYM00197 | 19 | 611 | *Bacillus* sp. | — | — | — | — |
| SYM00201 | 19 | 612 | *Bacillus* sp. | — | — | — | — |
| SYM00202 | 19 | 613 | *Bacillus* sp. | — | — | — | — |
| SYM00215 | 19 | 615 | *Bacillus* sp. | — | — | — | — |
| SYM00233 | 19 | 621 | *Bacillus* sp. | — | — | — | — |
| SYM00016b | 25 | 529 | *Methylobacterium* sp. | — | — | 1 | 1 |
| SYM00236 | 25 | 623 | *Methylobacterium* sp. | — | — | 1 | 1 |
| SYM00237 | 25 | 624 | *Methylobacterium* sp. | — | — | 1 | 1 |
| SYM00240 | 25 | 625 | *Methylobacterium* sp. | — | — | 1 | 1 |
| SYM00501 | 27 | 638 | *Burkholderia* sp. | 3 | 1 | — | — |
| SYM00504 | 27 | 640 | *Burkholderia* sp. | 3 | 1 | — | — |
| SYM00536 | 27 | 656 | *Burkholderia* sp. | 3 | 1 | — | — |
| SYM00538e | 27 | 659 | *Burkholderia* sp. | 1 | 1 | — | — |
| SYM00566a | 27 | 682 | *Burkholderia* sp. | 2 | 1 | — | — |
| SYM00568 | 27 | 683 | *Burkholderia* sp. | 2 | 1 | — | — |
| SYM00570 | 27 | 684 | *Burkholderia* sp. | 2 | 1 | — | — |
| SYM00574 | 27 | 685 | *Burkholderia* sp. | 2 | 1 | — | — |
| SYM00575 | 27 | 686 | *Burkholderia* sp. | 3 | 1 | — | — |
| SYM00578 | 27 | 687 | *Burkholderia* sp. | 2 | 1 | — | — |
| SYM00621 | 27 | 721 | *Burkholderia* sp. | 1 | 1 | — | — |
| SYM00623 | 27 | 722 | *Burkholderia* sp. | 1 | 1 | — | — |
| SYM00624 | 27 | 723 | *Burkholderia* sp. | 1 | 1 | — | — |
| SYM00633 | 27 | 727 | *Burkholderia* sp. | 1 | 1 | 1 | 1 |
| SYM00822 | 27 | 776 | *Burkholderia* sp. | — | — | — | — |
| SYM00037 | 28 | 543 | *Bacillus* sp. | — | — | — | — |
| SYM00051 | 28 | 549 | *Microbacterium* sp. | — | 2 | — | — |
| SYM00104 | 28 | 582 | *Microbacterium* sp. | 1 | — | — | — |
| SYM00177 | 28 | 597 | *Microbacterium* sp. | — | — | — | — |

TABLE 3-continued

Functional assays to examine the potential for seed microbes to confer novel functions to crops.

| | | | | | | | |
|---|---|---|---|---|---|---|---|
| SYM00514a | 28 | 648 | *Microbacterium* sp. | — | — | — | — |
| SYM00523 | 28 | 652 | *Microbacterium* sp. | — | — | — | — |
| SYM00538h | 28 | 660 | *Microbacterium* sp. | — | — | — | — |
| SYM00542 | 28 | 661 | *Microbacterium* sp. | — | — | 1 | 1 |
| SYM00556 | 28 | 674 | *Microbacterium* sp. | — | — | 1 | 1 |
| SYM00581a | 28 | 695 | *Microbacterium* sp. | — | — | — | — |
| SYM00586c | 28 | 703 | *Microbacterium* sp. | — | — | 1 | 1 |
| SYM00587 | 28 | 704 | *Microbacterium* sp. | — | — | 2 | 2 |
| SYM00598 | 28 | 712 | *Microbacterium* sp. | — | — | — | — |
| SYM00757 | 28 | 762 | *Microbacterium* sp. | — | — | — | — |
| SYM00760 | 28 | 764 | *Microbacterium* sp. | — | — | — | — |
| SYM00780 | 28 | 771 | *Microbacterium* sp. | — | — | — | — |
| SYM00832 | 28 | 781 | *Microbacterium* sp. | 1 | — | — | — |
| SYM00015 | 29 | 528 | *Xanthomonas* sp. | 1 | — | 2 | 2 |
| SYM00021 | 29 | 536 | *Xanthomonas* sp. | 2 | — | 3 | 3 |
| SYM00179 | 29 | 599 | *Xanthomonas* sp. | 1 | — | 2 | 2 |
| SYM00182 | 29 | 602 | *Xanthomonas* sp. | 1 | — | 1 | 1 |
| SYM00252 | 29 | 630 | *Xanthomonas* sp. | — | — | — | — |
| SYM00565a | 30 | 680 | *Rhodococcus* sp. | — | 1 | — | — |
| SYM00580g | 30 | 693 | *Rhodococcus* sp. | — | 1 | — | — |
| SYM00753 | 30 | 760 | *Rhodococcus* sp. | 1 | 1 | — | — |
| SYM00762 | 30 | 766 | *Rhodococcus* sp. | 1 | — | — | — |
| SYM00775 | 30 | 770 | *Rhodococcus* sp. | 1 | 1 | — | — |
| SYM00589 | 31 | 707 | *Paenibacillus* sp. | — | — | — | — |
| SYM00057b | 37 | 1446 | *Burkholderia phytofirmans* | — | 1 | 1 | 1 |
| SYM00102 | 38 | 581 | *Staphylococcus* sp. | — | — | — | — |
| SYM00072 | 39 | 566 | *Bacillus* sp. | 2 | — | — | — |
| SYM00075 | 39 | 567 | *Bacillus* sp. | 2 | — | — | — |
| SYM00249 | 39 | 628 | *Bacillus* sp. | — | — | — | — |
| SYM00507 | 39 | 645 | *Bacillus* sp. | 2 | 1 | — | — |
| SYM00553 | 39 | 671 | *Bacillus* sp. | — | 1 | — | — |
| SYM00562 | 39 | 677 | *Bacillus* sp. | 2 | — | — | — |
| SYM00564 | 39 | 679 | *Bacillus* sp. | 2 | 1 | — | — |
| SYM00580e | 39 | 692 | *Bacillus* sp. | — | 1 | — | — |
| SYM00581b | 39 | 696 | *Bacillus* sp. | 2 | — | — | — |
| SYM00581c | 39 | 697 | *Bacillus* sp. | — | — | — | — |
| SYM00601 | 39 | 714 | *Bacillus* sp. | 1 | — | — | — |
| SYM00036 | 41 | 542 | *Bacillus* sp. | 3 | 2 | — | — |
| SYM00110 | 41 | 586 | *Bacillus* sp. | 3 | 1 | — | — |
| SYM00193 | 41 | 609 | *Bacillus* sp. | 3 | — | — | — |
| SYM00218 | 41 | 617 | *Bacillus* sp. | 3 | 1 | — | — |
| SYM00250 | 41 | 629 | *Bacillus* sp. | — | 1 | — | — |
| SYM00697 | 41 | 745 | *Bacillus* sp. | 3 | 3 | — | — |
| SYM00704 | 41 | 746 | *Bacillus* sp. | 3 | 3 | — | — |
| SYM00017c | 45 | 533 | *Sphingomonas* sp. | — | — | 1 | 1 |
| SYM00062b | 45 | 558 | *Sphingomonas* sp. | — | — | 1 | 1 |
| SYM00065 | 45 | 561 | *Sphingomonas* sp. | — | — | — | — |
| SYM00168 | 45 | 589 | *Sphingomonas* sp. | — | 1 | 2 | 2 |
| SYM00169 | 45 | 590 | *Sphingomonas* sp. | — | 1 | 2 | 2 |
| SYM00231 | 46 | 620 | *Sphingobium* sp. | — | 1 | 2 | 2 |
| SYM00975 | 51 | 843 | *Herbaspirillum* sp. | — | — | — | — |
| SYM00506c | 53 | 643 | *Paenibacillus* sp. | — | — | — | — |
| SYM00506d | 53 | 644 | *Paenibacillus* sp. | — | — | — | — |
| SYM00545 | 53 | 664 | *Paenibacillus* sp. | — | 1 | — | — |
| SYM00549 | 53 | 668 | *Paenibacillus* sp. | — | — | — | — |
| SYM00554 | 53 | 672 | *Paenibacillus* sp. | — | 1 | — | — |
| SYM00555 | 53 | 673 | *Paenibacillus* sp. | — | 1 | — | — |
| SYM00012 | 55 | 1447 | *Microbacterium binotii* | 1 | — | — | — |
| SYM00046 | 56 | 545 | *Enterobacter* sp. | 1 | 3 | 1 | 1 |
| SYM00050 | 56 | 548 | *Enterobacter* sp. | — | 2 | 1 | 1 |
| SYM00628 | 56 | 726 | *Enterobacter* sp. | 1 | 1 | 1 | 1 |
| SYM00106 | 59 | 583 | *Micrococcus* sp. | — | — | 1 | 1 |

TABLE 3-continued

Functional assays to examine the potential for seed microbes to confer novel functions to crops.

| | | | | | | | |
|---|---|---|---|---|---|---|---|
| SYM00107 | 59 | 584 | *Micrococcus* sp. | — | — | — | — |
| SYM00108 | 59 | 585 | *Micrococcus* sp. | — | — | 1 | 1 |
| SYM00090 | 62 | 575 | *Chryseobacterium* sp. | 1 | — | — | — |
| SYM00002 | 66 | 521 | *Agrobacterium* sp. | — | — | 2 | 2 |
| SYM00017a | 66 | 531 | *Agrobacterium* sp. | — | — | 2 | 2 |
| SYM00714 | 66 | 750 | *Agrobacterium* sp. | — | — | 1 | 1 |
| SYM00060 | 67 | 556 | *Staphylococcus* sp. | — | — | — | — |
| SYM00071 | 76 | 565 | *Bacillus* sp. | — | — | — | — |
| SYM00204 | 76 | 614 | *Bacillus* sp. | — | — | — | — |
| SYM00563 | 76 | 678 | *Bacillus* sp. | — | — | — | — |
| SYM00617 | 76 | 719 | *Bacillus* sp. | — | — | — | — |
| SYM00960 | 82 | 831 | *Luteibacter* sp. | — | — | — | — |
| SYM00940 | 83 | 815 | | — | — | — | — |
| SYM00713 | 84 | 749 | *Erwinia* sp. | — | 1 | 1 | 1 |
| SYM00992 | 126 | 856 | *Sphingomonas* sp. | — | — | — | — |
| SYM00063 | 134 | 559 | *Microbacterium* sp. | 1 | — | — | — |
| SYM00226 | 134 | 618 | *Microbacterium* sp. | — | — | — | — |
| SYM00246 | 134 | 627 | *Microbacterium* sp. | — | 1 | — | — |
| SYM00524 | 134 | 653 | *Microbacterium* sp. | — | — | — | — |
| SYM00199 | 135 | 1448 | *Bacillus* sp. | — | — | — | — |
| SYM00172 | 146 | 592 | *Pantoea* sp. | 2 | — | 1 | 1 |
| SYM00527 | 146 | 655 | *Erwinia* sp. | — | — | 1 | 1 |
| SYM00644 | 146 | 728 | *Erwinia* sp. | — | — | 1 | 1 |
| SYM00648 | 146 | 732 | | 1 | 1 | — | — |
| SYM00538a | 172 | 658 | *Sphingomonas* sp. | — | — | 1 | 1 |
| SYM00508 | 196 | 646 | | — | — | 1 | 1 |

| SYM # | Secretes siderophores | Phosphate Solubilization | Growth on Nitrogen Free LGI | ACC Deaminase Activity | Produces Auxin/Indoles | Produces Acetoin |
|---|---|---|---|---|---|---|
| SYM00033 | 1 | 2 | — | — | 3 | — |
| SYM00173 | — | 2 | Y | — | 3 | 1 |
| SYM00176 | 2 | 1 | — | — | 2 | 1 |
| SYM00605 | 2 | 2 | — | — | 1 | — |
| SYM00607 | 2 | 2 | — | — | 1 | 2 |
| SYM00608 | 1 | — | — | 1 | 1 | 1 |
| SYM00620 | — | 1 | — | — | 2 | 2 |
| SYM00658 | — | 2 | — | 1 | 2 | 3 |
| SYM00660 | 1 | — | — | 1 | — | 1 |
| SYM00011 | — | 1 | Y | — | 2 | — |
| SYM00011b | — | — | — | — | — | 1 |
| SYM00013 | 2 | — | Y | — | 2 | — |
| SYM00014 | 1 | — | Y | — | 2 | — |
| SYM00062 | 2 | — | — | 1 | 2 | — |
| SYM00068 | 2 | 1 | — | 3 | 2 | — |
| SYM00069 | — | — | — | — | — | 2 |
| SYM00646 | 3 | — | — | — | 2 | — |
| SYM00649 | 1 | — | — | 3 | 2 | — |
| SYM00650 | — | — | — | 3 | 2 | — |
| SYM00657 | — | — | — | 3 | 2 | — |
| SYM00672 | 2 | 1 | — | 3 | 1 | — |
| SYM00709 | — | — | — | — | — | 3 |
| SYM00013b | — | — | — | — | — | 1 |
| SYM00167 | — | — | — | — | 1 | — |
| SYM00171 | 2 | — | — | — | 1 | — |
| SYM00174 | — | — | — | — | 1 | 1 |
| SYM00178 | 1 | — | — | — | — | 1 |
| SYM00180 | — | — | — | — | — | 1 |
| SYM00181 | — | — | — | — | — | 2 |
| SYM00235 | — | 1 | Y | — | 3 | 3 |
| SYM00244 | — | 1 | — | — | — | 1 |
| SYM00525 | — | — | — | — | 2 | 1 |
| SYM00625 | — | — | — | 1 | 1 | — |
| SYM00645 | 3 | — | — | 3 | 1 | — |
| SYM00647 | — | — | — | — | 1 | 3 |
| SYM00690 | — | — | — | 1 | 1 | 1 |
| SYM00691 | — | — | — | 1 | — | 1 |
| SYM00693 | — | — | — | 1 | — | 1 |
| SYM00712 | — | — | — | 1 | 1 | — |
| SYM00716 | — | — | — | 1 | 1 | 1 |
| SYM00722 | — | — | — | 1 | 1 | — |

TABLE 3-continued

Functional assays to examine the potential for seed microbes to confer novel functions to crops.

| | | | | | | |
|---|---|---|---|---|---|---|
| SYM00731b | — | — | — | 1 | 1 | — |
| SYM00784 | — | — | — | — | 1 | — |
| SYM00188 | — | — | — | — | — | 2 |
| SYM00190 | — | 1 | — | — | — | — |
| SYM00195 | — | 2 | — | — | — | 2 |
| SYM00217 | — | 2 | — | — | — | — |
| SYM00227 | — | 1 | — | 1 | — | — |
| SYM00597 | — | 1 | — | — | — | 3 |
| SYM00017b | — | 2 | — | — | 3 | — |
| SYM00018 | — | — | — | — | 2 | — |
| SYM00020 | — | 1 | Y | — | 3 | — |
| SYM00022 | 1 | — | — | — | 2 | — |
| SYM00025 | — | — | — | — | 2 | 1 |
| SYM00043 | 1 | 2 | Y | — | 1 | — |
| SYM00047 | — | 2 | — | — | 1 | 1 |
| SYM00049 | 1 | — | — | — | 3 | 1 |
| SYM00055 | 1 | 2 | — | — | — | 1 |
| SYM00057 | — | — | — | — | — | 1 |
| SYM00058 | — | — | — | — | — | 3 |
| SYM00078 | 1 | 2 | Y | — | 3 | — |
| SYM00081 | 1 | 2 | Y | — | 1 | — |
| SYM00082a | 1 | — | Y | — | 1 | — |
| SYM00085 | 1 | 2 | — | — | 1 | 1 |
| SYM00086 | 1 | 2 | — | — | 1 | 1 |
| SYM00088 | — | — | — | — | — | 3 |
| SYM00094 | 1 | 2 | Y | — | 1 | 1 |
| SYM00095 | 1 | 2 | Y | — | 1 | 1 |
| SYM00096 | 1 | — | — | — | 1 | 1 |
| SYM00100 | 1 | 1 | — | — | 3 | — |
| SYM00101 | 1 | — | — | — | 2 | — |
| SYM00502 | 1 | 1 | — | — | 3 | — |
| SYM00506 | 1 | 1 | — | — | 3 | 1 |
| SYM00506b | 1 | 1 | — | — | 3 | 3 |
| SYM00511 | — | — | — | — | 2 | 1 |
| SYM00514b | — | 2 | — | — | 3 | 3 |
| SYM00514c | — | — | — | 3 | — | 1 |
| SYM00514d | — | — | — | — | 2 | 3 |
| SYM00731a | — | 1 | — | 1 | 2 | — |
| SYM00785 | — | 2 | — | 1 | 2 | — |
| SYM00544 | — | 1 | — | — | 3 | — |
| SYM00545b | — | — | — | — | 2 | — |
| SYM00548 | — | 1 | — | — | 2 | — |
| SYM00552 | — | — | — | — | 2 | 1 |
| SYM00558 | — | 1 | — | — | 2 | — |
| SYM00580b | — | — | — | — | 1 | — |
| SYM00580d | — | — | — | — | 2 | — |
| SYM00583 | — | 1 | — | — | 2 | — |
| SYM00584 | — | 1 | — | — | 2 | — |
| SYM00588 | — | 2 | — | — | 2 | 2 |
| SYM00596 | — | 1 | — | — | 2 | 3 |
| SYM00600 | — | 2 | — | — | 2 | — |
| SYM00746 | — | 1 | — | 1 | 1 | 1 |
| SYM00752 | — | 1 | — | 1 | 2 | — |
| SYM00756 | — | 1 | — | 1 | 1 | — |
| SYM00763 | — | 1 | — | — | 2 | — |
| SYM00783 | — | 1 | — | — | 2 | — |
| SYM00812 | — | — | — | — | 2 | — |
| SYM00064a | — | — | — | — | 1 | — |
| SYM00183 | — | — | — | — | 1 | 2 |
| SYM00184 | — | — | — | — | 1 | 3 |
| SYM00543 | — | — | — | — | 1 | — |
| SYM00595 | — | — | — | — | 1 | — |
| SYM00580c | 1 | — | — | 1 | 1 | — |
| SYM00547 | 2 | — | — | 1 | 1 | — |
| SYM00551 | 1 | — | — | 2 | 1 | — |
| SYM00560 | 1 | — | — | — | 2 | — |
| SYM00565b | 1 | 1 | — | 1 | 1 | 1 |
| SYM00580i | — | — | — | — | 1 | — |
| SYM00585 | 1 | 2 | — | 1 | 2 | — |
| SYM00586b | 2 | — | — | — | 2 | — |
| SYM00588b | — | — | — | — | 3 | 2 |
| SYM00591 | — | — | — | 3 | 1 | — |
| SYM00602 | 3 | — | — | — | 1 | 2 |
| SYM00758 | — | — | — | 3 | 1 | — |
| SYM00761 | 1 | — | — | 1 | — | — |
| SYM00764 | 1 | — | — | 1 | 1 | — |
| SYM00765 | — | — | — | — | — | 3 |

TABLE 3-continued

Functional assays to examine the potential for seed microbes to confer novel functions to crops.

| | | | | | | |
|---|---|---|---|---|---|---|
| SYM00824 | — | — | — | 3 | 1 | — |
| SYM00828 | 1 | — | — | — | 1 | — |
| SYM00830 | — | — | — | 3 | 1 | — |
| SYM00831 | 1 | 1 | — | 1 | 1 | — |
| SYM00028 | — | 1 | — | — | 1 | 3 |
| SYM00052 | — | 1 | — | — | 1 | 1 |
| SYM00053 | — | 1 | — | — | — | 1 |
| SYM00054 | 1 | — | — | — | — | 3 |
| SYM00175 | 1 | 2 | Y | — | 1 | — |
| SYM00627 | — | 2 | — | 1 | — | 3 |
| SYM00715 | — | 2 | — | 1 | — | 2 |
| SYM00189 | — | — | — | — | — | 1 |
| SYM00192 | — | — | — | — | — | — |
| SYM00197 | — | — | — | — | 1 | 2 |
| SYM00201 | — | — | — | — | 1 | — |
| SYM00202 | — | 2 | — | — | — | — |
| SYM00215 | — | — | — | — | — | 3 |
| SYM00233 | — | — | Y | — | 2 | 1 |
| SYM00016b | — | — | — | — | 1 | 1 |
| SYM00236 | — | 1 | Y | 1 | — | — |
| SYM00237 | — | 1 | Y | 1 | 2 | — |
| SYM00240 | — | 1 | Y | 3 | — | — |
| SYM00501 | 2 | — | — | 3 | 2 | — |
| SYM00504 | 2 | — | — | 3 | 2 | — |
| SYM00536 | 3 | 1 | — | 1 | 2 | — |
| SYM00538e | 2 | 1 | — | 3 | 1 | — |
| SYM00566a | 2 | — | — | 3 | — | 3 |
| SYM00568 | 2 | — | — | 3 | 1 | — |
| SYM00570 | 2 | 1 | — | 3 | 1 | — |
| SYM00574 | 2 | 1 | — | 3 | 1 | 1 |
| SYM00575 | 2 | 1 | — | 3 | 1 | — |
| SYM00578 | 2 | 2 | — | 3 | — | — |
| SYM00621 | 3 | — | — | 3 | 1 | — |
| SYM00623 | 3 | — | — | 3 | — | — |
| SYM00624 | 3 | — | — | 3 | — | — |
| SYM00633 | — | 2 | — | 1 | 3 | 3 |
| SYM00822 | 3 | 1 | — | — | — | — |
| SYM00037 | — | — | — | — | — | 2 |
| SYM00051 | 2 | — | — | — | 2 | 2 |
| SYM00104 | — | — | Y | — | — | — |
| SYM00177 | — | — | — | — | 1 | 3 |
| SYM00514a | — | — | — | — | 2 | 2 |
| SYM00523 | — | — | — | — | 2 | 2 |
| SYM00538h | — | — | — | — | — | 2 |
| SYM00542 | — | — | — | — | 1 | 1 |
| SYM00556 | — | — | — | — | 3 | — |
| SYM00581a | — | — | — | — | 2 | 3 |
| SYM00586c | — | — | — | — | 2 | 2 |
| SYM00587 | — | — | — | — | 2 | 1 |
| SYM00598 | — | — | — | — | 1 | 2 |
| SYM00757 | — | — | — | 1 | — | 3 |
| SYM00760 | — | — | — | 1 | — | 2 |
| SYM00780 | 1 | — | — | — | 1 | — |
| SYM00832 | — | — | — | — | — | 1 |
| SYM00015 | 2 | — | Y | — | 1 | 1 |
| SYM00021 | 2 | — | — | — | 2 | — |
| SYM00179 | — | 1 | — | — | 1 | 1 |
| SYM00182 | — | 1 | — | 1 | 3 | 3 |
| SYM00252 | — | — | Y | — | — | — |
| SYM00565a | — | 1 | — | — | — | — |
| SYM00580g | 2 | 1 | — | — | 1 | — |
| SYM00753 | — | — | Y | 1 | 1 | 2 |
| SYM00762 | 1 | 1 | Y | — | 1 | — |
| SYM00775 | 2 | 1 | Y | 1 | 1 | — |
| SYM00589 | — | — | — | — | 3 | 2 |
| SYM00057b | 1 | 1 | Y | 3 | 1 | — |
| SYM00102 | — | — | — | — | — | 2 |
| SYM00072 | — | — | — | — | — | 3 |
| SYM00075 | — | — | — | — | — | 3 |
| SYM00249 | — | — | — | — | — | — |
| SYM00507 | — | — | — | — | 2 | 1 |
| SYM00553 | — | — | — | — | — | 1 |
| SYM00562 | — | — | — | — | — | — |
| SYM00564 | — | — | — | — | — | — |
| SYM00580e | 1 | — | — | — | — | 1 |
| SYM00581b | — | — | — | — | 2 | 3 |
| SYM00581c | — | — | — | 1 | 1 | 3 |

TABLE 3-continued

Functional assays to examine the potential for seed microbes to confer novel functions to crops.

| | | | | | | |
|---|---|---|---|---|---|---|
| SYM00601 | — | — | — | — | — | 3 |
| SYM00036 | — | — | — | — | — | 3 |
| SYM00110 | — | — | Y | — | 1 | — |
| SYM00193 | — | — | — | — | — | 1 |
| SYM00218 | — | 1 | — | — | — | — |
| SYM00250 | — | 1 | Y | — | — | — |
| SYM00697 | — | — | — | — | — | 3 |
| SYM00704 | — | — | — | — | — | 3 |
| SYM00017c | — | — | Y | — | 2 | 1 |
| SYM00062b | — | — | — | — | 3 | 1 |
| SYM00065 | — | — | — | — | — | 1 |
| SYM00168 | — | 2 | Y | — | 2 | 1 |
| SYM00169 | — | 2 | Y | — | 3 | 3 |
| SYM00231 | 1 | 2 | Y | — | 2 | — |
| SYM00975 | 2 | 2 | — | — | — | 3 |
| SYM00506c | — | — | — | — | 3 | 1 |
| SYM00506d | — | — | — | — | 2 | — |
| SYM00545 | — | — | — | — | 2 | — |
| SYM00549 | — | — | — | — | 1 | — |
| SYM00554 | — | — | — | — | 1 | 1 |
| SYM00555 | — | — | — | — | — | — |
| SYM00012 | — | 1 | — | — | 1 | 1 |
| SYM00046 | 2 | 1 | — | — | 1 | 3 |
| SYM00050 | 1 | 1 | — | — | 2 | 2 |
| SYM00628 | — | 1 | — | 1 | 3 | 3 |
| SYM00106 | — | — | Y | — | — | — |
| SYM00107 | — | — | Y | — | — | 1 |
| SYM00108 | — | — | Y | — | — | — |
| SYM00090 | 1 | — | — | — | — | — |
| SYM00002 | — | — | — | — | 3 | — |
| SYM00017a | — | — | — | — | 3 | — |
| SYM00714 | — | — | — | 1 | 2 | — |
| SYM00060 | — | — | — | — | — | 3 |
| SYM00071 | — | — | — | — | — | 2 |
| SYM00204 | — | — | — | — | — | — |
| SYM00563 | — | — | — | — | — | — |
| SYM00617 | — | — | — | — | 1 | 2 |
| SYM00960 | 2 | — | — | — | — | 3 |
| SYM00940 | — | 1 | — | — | — | 3 |
| SYM00713 | 1 | 1 | — | 1 | 2 | 1 |
| SYM00992 | — | 2 | — | — | — | 2 |
| SYM00063 | — | — | — | — | 1 | 3 |
| SYM00226 | — | — | — | — | — | — |
| SYM00246 | — | — | — | — | 1 | 1 |
| SYM00524 | — | — | — | — | 1 | 3 |
| SYM00199 | — | 2 | — | — | — | — |
| SYM00172 | 3 | 2 | Y | — | 3 | 3 |
| SYM00527 | — | 1 | — | — | 3 | 1 |
| SYM00644 | 1 | 1 | — | 3 | 2 | 2 |
| SYM00648 | 1 | 2 | — | 1 | 1 | 3 |
| SYM00538a | — | — | — | — | 2 | — |
| SYM00508 | — | 1 | — | — | 2 | — |

Legend:
"—" indicates no significant increase;
"1" = low activity;
"2" = medium activity;
"3" = high activity,
"Y" = yes.

TABLE 4

Taxonomic identity of seed bacterial isolates capable of fixing nitrogen

| Genus | Number of seed isolates growing on N-free media |
|---|---|
| *Bacillus* sp. | 3 |
| *Burkholderia* sp. | 1 |
| *Curtobacterium* sp. | 1 |
| *Enterobacter* sp. | 1 |
| *Methylobacterium* sp. | 3 |
| *Microbacterium* sp. | 1 |
| *Micrococcus* sp. | 3 |
| *Pantoea* sp. | 9 |
| *Pseudomonas* sp. | 3 |
| *Rhodococcus* sp. | 3 |
| *Sphingobium* sp. | 1 |
| *Sphingomonas* sp. | 3 |
| *Xanthomonas* sp. | 2 |

ACC Deaminase Activity

Microbes were assayed for growth with ACC as their sole source of nitrogen. Prior to media preparation all glassware was cleaned with 6 M HCl. A 2 M filter sterilized solution of ACC (#1373A, Research Organics, USA) was prepared in water. Two µl mL$^{-1}$ of this was added to autoclaved LGI broth (see above), and 250 µL aliquots were placed in the wells of a 96 well plate. The plate was inoculated with a 96 pin library replicator, sealed with a breathable membrane, incubated at 28° C. without shaking for 5 days, and OD600 readings taken. Only wells that were significantly more turbid than their corresponding nitrogen free LGI wells were considered to display ACC deaminase activity.

Plant stress reactions are strongly impacted by the plant's own production and overproduction of the gaseous hormone ethylene. Ethylene is metabolized from its precursor 1-aminocyclopropane-1-carboxylate (ACC) which can be diverted from ethylene metabolism by microbial and plant enzymes having ACC deaminase activity. As the name implies, ACC deaminase removes molecular nitrogen from the ethylene precursor, removing it as a substrate for production of the plant stress hormone and providing for the microbe a source of valuable nitrogen nutrition. This microbial ability to inhibit ethylene production is very important for plant health as damage to growth and productivity under various stress conditions is believed to result from the plant's own over-production of ethylene (Saleem et al. 2007, Journal of Industrial Microbiology & Biotechnology 34(10): 635-648).

In total, of the 247 isolates, there were 68 (28%) which had greater growth on nitrogen free LGI media supplemented with ACC, than in nitrogen free LGI. Of these, 11% had very high ACC deaminase activity and these were mostly isolates of *Achromobacter*, *Burkholderia*, and *Pseudomonas* (Table 5). Chief amongst these were *Burkholderia* species which held ACC deaminase as their most distinctive in vitro characteristic—94% or 15 out of 16 *Burkholderia* isolates had ACC deaminase activity. Of *Burkholderia* isolates, 81% had strong ACC deaminase activity, while 42% of *Achromobacter* species (5 of 12 isolates) had strong ACC deaminase activity, and next were *Pseudomonas* where 5 of 14 isolates (42%) had strong activity. Many Curtobacteria isolates appeared to have ACC deaminase activity as well, however these were all rated low (as 1) and thus of less interest than the preceding groups of isolates.

TABLE 5

Taxonomic identity of seed bacterial isolates capable of utilizing ACC as a nitrogen source.

| Genus | Seed isolates growing on ACC as the sole N source |
|---|---|
| *Achromobacter* sp. | 12 |
| *Agrobacterium* sp. | 1 |
| *Bacillus* sp. | 1 |
| *Burkholderia* sp. | 15 |
| *Curtobacterium* sp. | 9 |
| *Enterobacter* sp. | 3 |
| *Erwinia* sp. | 5 |
| *Methylobacterium* sp. | 3 |
| *Microbacterium* sp. | 2 |
| *Ochrobactrum* sp. | 3 |
| *Pantoea* sp. | 1 |
| *Pseudomonas* sp. | 7 |
| *Rhodococcus* sp. | 2 |
| *Xanthomonas* sp. | 1 |

Acetoin and Diacetyl Production

The method was adapted from the work of Phalip et al. (1994), supra. 250 ml of autoclaved R2A broth supplemented with 0.5% glucose was aliquoted into a 96 well plate (#07-200-700, Fisher). The bacterial endophytes from a glycerol stock plate were inoculated into the plate using a flame-sterilized 96 pin replicator, sealed with a breathable membrane, then incubated for 3 days without shaking at 28° C. At day 5, 50 µl well$^{-1}$ was added of freshly blended Barritt's Reagents A and B [5 g L$^{-1}$ creatine mixed 3:1 (v/v) with freshly prepared ∝-naphthol (75 g L$^{-1}$ in 2.5 M sodium hydroxide)]. After 15 minutes, plates were scored for red or pink coloration relative to a copper colored negative control, measured as 525 nm absorption on a plate reader.

A large number of seed bacteria showed a detectable level of pink or red color development (126 out of 247; See Table 3). Seventy of 247 isolates had strong production of acetoin or butanediol as detected by this assay. *Bacillus* (13 of 33), *Enterobacter* (8 or 16) and *Microbacterium* (12 of 21) isolates were the most intense producers of acetoin/butanediol in this collection. In addition, two of the three isolates of *Stenotrophomonas* included in this study were also strong acetoin/butanediol producers.

Siderophore Production

To ensure no contaminating iron was carried over from previous experiments, all glassware was deferrated with 6 M HCl and water prior to media preparation (Cox 1994, Methods Enzymol 235:315-329). In this cleaned glassware, R2A broth media, which is iron limited, was prepared and poured (250 ul well$^{-1}$) into 96 well plates and the plate then inoculated with bacteria using a 96 pin plate replicator. After 3 days of incubation at 28° C. without shaking, to each well was added 100 ul of O-CAS preparation without gelling agent (Perez-Miranda et al. 2007, J Microbiol Methods 70(1):127-131). One liter of O-CAS reagent was prepared using the cleaned glassware by mixing 60.5 mg of chrome azurol S (CAS), 72.9 mg of hexadecyltrimethyl ammonium bromide (HDTMA), 30.24 g of finely crushed Piperazine-1,4-bis-2-ethanesulfonic acid (PIPES) with 10 ml of 1 mM FeCl$_3$.6H$_2$O in 10 mM HCl solvent. The PIPES had to be finely powdered and mixed gently with stirring (not shaking) to avoid producing bubbles, until a deep blue color was achieved. 15 minutes after adding the reagent to each well, color change was scored by looking for purple halos (catechol type siderophores) or orange colonies (hydroxamate siderophores) relative to the deep blue of the O-CAS.

Siderophore production by bacteria on a plant surface or inside a plant may both show that a microbe is equipped to grow in a nutrient limited environment, and perhaps protect the plant environment from invasion by other, perhaps undesirable microbes. We searched for two types of siderophore which result in purple color change (catechol type siderophores) or orange color change (hydroxamate siderophores) after addition of the blue O-CAS reagent to 96 well plates. A large number of bacteria showed a detectable level of color change relative to the deep blue of the O-CAS; 80 out of 247. Notably, 32 of 247 isolates had strong production of siderophores. Interestingly, strong siderophore producers included a large number (14) of the 16 *Burkholderia* isolates (Table 6). Many isolates of *Achromobacter* (9 of 12) and *Pantoea* (15 of 26) were able to induce weak color change in the O-CAS material.

TABLE 6

Taxonomic identity of seed bacterial
isolates producing siderophores

| Genus | Number of siderophore producing seed isolates |
|---|---|
| *Achromobacter* sp. | 3 |
| *Burkholderia* sp. | 14 |
| *Curtobacterium* sp. | 2 |
| *Enterobacter* sp. | 1 |
| *Microbacterium* sp. | 1 |
| *Pantoea* sp. | 2 |
| *Pseudomonas* sp. | 5 |
| *Rhodococcus* sp. | 2 |
| *Xanthomonas* sp. | 2 |

Pectinase Activity

Iodine reacts with pectin to form a dark blue-colored complex, leaving clear halos as evidence of extracellular enzyme activity. Adapting a previous protocol (Soares et al. 1999, Rev de Microbiol 30: 299-303) 0.2% (w/v) of citrus pectin (#76280, Sigma) and 0.1% triton X-100 were added to R2A media, autoclaved and poured into 150 mm plates. Bacteria were inoculated using a 96 pin plate replicator. After 3 days of culturing in the darkness at 25° C., pectinase activity was visualized by flooding the plate with Gram's iodine. Positive colonies were surrounded by clear halos. In our study, a large number, roughly 83 of the 247 isolates, had detectable pectinase activity, and 21 of these isolates had moderate to strong results visualized as medium to large halos indicating copious diffusion of enzyme away from the bacteria.

Cellulase Activity

Iodine reacts with cellulose to form a dark brown/blue-colored complex, leaving clear halos as evidence of extracellular enzyme activity. Adapting a previous protocol (Kasana et al. 2008, Curr Microbiol 57(5): 503-507), 0.2% carboxymethylcellulose (CMC) sodium salt (#C5678, Sigma) and 0.1% triton X-100 were added to a starch free variant of R2A media, autoclaved and poured into 150 mm plates. Bacteria were inoculated using a 96 pin plate replicator. After 3 days of culturing in the darkness at 25° C., cellulose activity was visualized by flooding the plate with Gram's iodine. Positive colonies were surrounded by clear halos.

A large number of our isolates, roughly 83 of the 247 isolates, had detectable cellulose activity, and 21 of these isolates had moderate to strong results visualized as medium to large halos indicating copious diffusion of enzyme away from the bacteria.

Antibiosis

Briefly, colonies of either *E. coli* DH5α (bacterial tester) or yeast *Saccharomyces cerevisiae* AH109 (fungal tester) were resuspended in 1 mL R2A broth to an OD600 of 0.2, and 40 µL of this was mixed with 40 mL of warm R2A agar for pouring a single rectangular Petri dish. Seed derived bacteria were inoculated onto plates using a flame sterilized 96 pin plate replicator, incubated for 3 days at 28° C. Antibiosis was scored by observing clear halos around endophyte colonies.

A total of 59 and 72 isolates showed antibiosis activity against either *E. coli* or yeast, respectively (Table 3). Antibiotic production by bacteria on a plant surface or inside a plant may both show that a microbe is ecologically aggressive (a survivor) and it may mean that it can help protect a plant against pathogens. Three genera of bacteria, *Bacillus*, *Enterobacter* and *Burkholderia* all had a large proportion of isolates (up to 45%, 50% and 88% respectively) which inhibited growth of *E. coli* and yeast, suggestive of a common mechanism of antiobiosis such as production and secretion of a broad spectrum antibiotic. As antibiosis effects were detected in the same 14 isolates of *Burkholderia* that produced siderophores, *Burkholderia* mediated antibiosis may have been be caused by localized iron starvation, inhibiting both yeast and *E. coli* growth. A large number of Ochrobacterum isolates also had antagonism towards yeast growth.

Example 4—Seed Endophyte Establishment and Persistence in Maize and Wheat

Seed endophytes colonize plant tissues and as part of their life cycle they can establish inside roots and disperse systemically throughout the plant vascular system and colonize stems, leaves, flowers and seeds. In order to track the fate of individual isolates, the individual endophytes are labeled with a marker such as green fluorescent protein (GFP) encoded in a multi copy plasmid. An isolate is transformed with the plasmid encoding the expression of GFP that can be detected by flow cytometry with excitation with a blue laser at 488 nm and light emission at 530 nm or fluorescent microscopy. The transformed bacterium will fluoresce green and thus can be readily discriminated from the native microbial community as indigenous green fluorescence does not occur in seed endophytes or microbial species associated with the rhizosphere or soils. Seeds are inoculated with such bacteria which colonize the germinating seed allowing the establishment, detection and enumeration of the GFP-labeled bacteria in specific tissues such as roots, stems and flowers as the plants develop and mature. Through the plant's life cycle and reproductive stages the tissues can be analyzed for the presence of the GFP labeled seed endophyte. This demonstrates that bacteria's ability to colonize and persist in vegetative plant tissues, in addition to seed surfaces and interiors where it was originally inoculated. Seed endophytes will be capable of propagation outside the seed and to be re-established on seeds to colonize new plant generations.

An isolate of *Pantoea* representing OTU#7 and an *Enterobacter* representing OTU#56 were successfully electroporated with the broad gram negative host range plasmid, pDSK-GFPuv (Wang et al. 2007, New Phytol 174(1): 212-23) This is a low copy plasmid, driving constitutive expression of very bright fluorescing GFP under UV light, in addition to carrying a constitutively expressed kanamycin resistance gene which can allow for selection against background, non-tagged microbes inherent in plant samples. These pDSK-GFPuv transformed bacteria were grown overnight in a volume of 10 ml, of 50% TSB and the next day, CFU were counted by serial dilution and plating on 50% TSA plates. At this time, 10 g of 58PM36 seed (Blue River Hybrid maize) in a sterile 50 mL conical tube was flooded with a mixture of 10 µl of plantability polymer Flo Rite 1706 and 500 µl of the GFP plasmid containing OTU#7 or OTU#56 bacteria in R2A broth. After vigorous shaking to ensure even coating of seed with bacteria, tubes were sealed and left at 25° C. for 7 days, at which time CFU of bacteria still surviving on seed were assessed by carbide bead beating with a Fastprep24 machine for 60 seconds at 5 M s$^{-1}$. Each 15 mL Falcon tube contained 3 seeds, 2 beads and 1 mL of sterile R2A broth. After agitation, 20 µL of the supernatant was then serially diluted, and 50 µL of the 10× diluted and 50 µL of the 1,000× diluted plated on halves of 50% TSA plates. Two of each seed type including untreated, OTU#7-

Figure 1B:
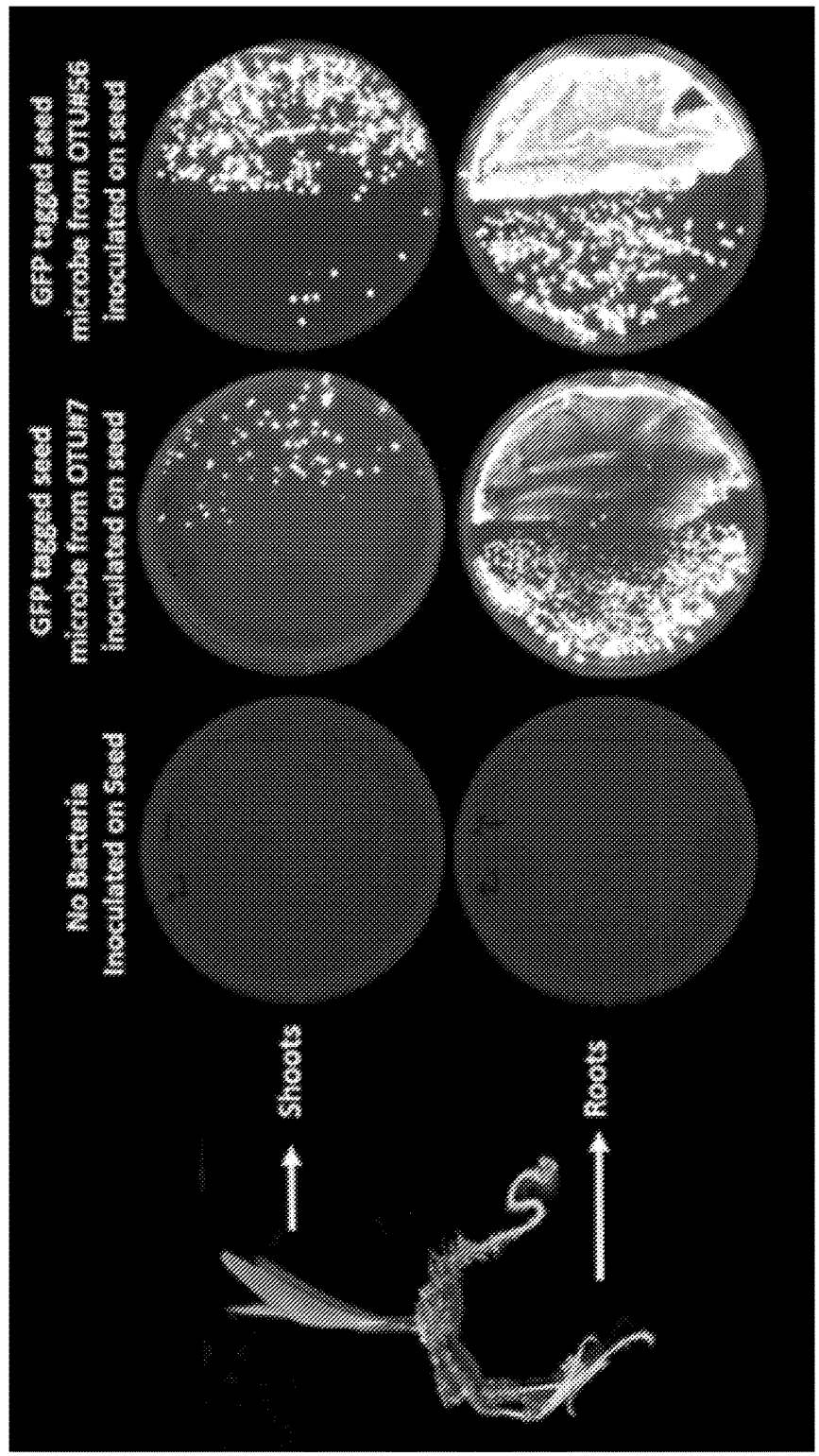
FIG. 1B depicts an alternative approach to observe plant colonization by seed endophytes by tagging the microbes with a kanamycin resistance and GFP containing plasmid. These microbes were coated onto unsterilized maize seed, which was dried in a 50 mL conical tube and stored at room temperature for a week before being planted in cups containing sterile sand in a greenhouse. After a week of growth, shoots and roots were macerated using bead beating, serially diluted to 10× and 1,000× before plating and colony counting under UV to determine green fluorescing CFUs per plant on TSA plates containing kanamycin. Control plant extracts were plated on kanamycin free agar and developed non-GFP containing colonies of several undescribed microbes.

GFP and OTU#56-GFP inoculated seeds were then planted 3 cm deep in 70% ethanol cleaned pots containing heat sterilized quartz sand, and watered daily with autoclaved water for 7 days as seedlings developed. At this time, seedlings were removed and shaken free from sand, cut into roots or shoots, weighed, placed in 15 mL Falcon tubes along with two carbide beads and either 1 mL of 50% TSB for shoots or 2 mL of 50% TSB for roots. These were then homogenized by shaking on the Fastprep24 for 120 seconds at 5M s$^{-1}$. Twenty µL of shoot and root homogenates were then serially diluted, and 50 µL of the 10× diluted and 50 µL of the 1,000× diluted plated on halves of 50% TSA plates. Non-inoculated seed were plated on antibiotic free TSA, but OTU#7-GFP and OTU#56-GFP plant extracts were placed on TSA plates containing 50 µg ml$^{-1}$ of kanamycin. See FIG. 1b for an example of fluorescing colonies of the two GFP transformed isolates on TSA plates containing kanamycin.

Based on colony counting of serial dilutions, OTU#7-GFP inoculum was at a level of 2.74×10$^9$ CFU mL$^{-1}$ (approximately 5.08×10$^7$ CFU seed$^{-1}$) when applied to seeds, and after 7 days at room temperature each seed still had about 4.44×10$^5$ CFU per seed. After 7 days of growth in a greenhouse exposed to fluctuations in light, heat, moisture and atmosphere, OTU#7-GFP inoculated seeds developed into a seedling with an average of 1.24×10$^6$ CFU g$^{-1}$ of root tissue and 7.93×10$^5$ CFU g$^{-1}$ of shoot tissue. Thus after planting seeds with approximately 4.44×10$^5$ CFU of OTU#7-GFP each, seedlings germinated and grew into plantlets containing an average of 1.02×10$^6$ CFU GFP labelled bacteria. This represents an almost three fold increase of bacterial numbers and indicates active growth and colonization of these bacteria in the plant, rather than passive survival for a week until the time of harvest.

OTU#56-GFP inoculum was at a level of 1.69×10$^9$ CFU mL$^{-1}$ (approximately 3.13×10$^7$ CFU seed$^{-1}$) when applied to seeds, and 7 days later each seed still had about 2.21×10$^6$ CFU living on its surface. After 7 days of growth in a greenhouse exposed to fluctuations in light, heat, moisture and atmosphere, OTU#56-GFP inoculated seeds developed into seedlings with an average of 4.71×10$^6$ CFU g$^{-1}$ of root tissue and 2.03×10$^4$ CFU g$^{-1}$ of shoot tissue. Thus after planting seeds with approximately 2.21×10$^6$ CFU of OTU#7-GFP each, seedlings germinated and grew into plantlets containing an average of 6.06×10$^5$ CFU GFP labelled bacteria.

Taken together, these two experiments successfully showed that seed derived endophytes are able to survive on a maize seed surface in large numbers under non-sterile greenhouse conditions for at least a week and are able to colonize and persist on the developing plant over time where they will have ongoing opportunities to influence and improve plant growth, health and productivity.

Example 5—Colonization of Grass Plants by Endophytes

The establishment of plant-microbe interactions is contingent on close proximity. The microbiome of the host plant consists of microorganisms inside tissues as well as those living on the surface and surrounding rhizosphere. The experiments described in this section confirm successful colonization of plants by endophytic bacteria by direct recovery of viable colonies from various tissues of the inoculated plant. The experiments were designed to reduce background microbes by the use of surface-sterilized seeds, and planting and growing the seeds in a sterile environment, to improve the observable colonization of the plant with the inoculated bacterium.

Description of Methods

Maize seeds of maize cultivar 58PM36 (Blue River Hybrid) were surface-sterilized by exposing them to chlorine gas overnight, using the methods described elsewhere. Sterile seeds were then inoculated with submerged in 0.5 OD overnight cultures (Tryptic Soy Broth) of isolates SYM00254 (a *Micrococcus* sp. of OTU 59), SYM00284 (a *Pantoea* sp. of OTU 0), SYM00290 (an *Actinobacter* of OTU 154), or SYM00292 (a *Paenibacillus* sp. of OTU 6) and allowed to briefly air dry. The seeds were then placed in tubes filled partially with a sterile sand-vermiculite mixture [(1:1 wt:wt)] and covered with 1 inch of the mixture, watered with sterile water, sealed and incubated in a greenhouse for 7 days. After incubation, various tissues of the plants were harvested and used as donors to isolate bacteria by placing tissue section in a homogenizer (TSB 20%) and mechanical mixing. The slurry was then serially diluted in 10-fold steps to 10$^{-3}$ and dilutions 1 through 10$^{-3}$ were plated on TSA 20% plates (1.3% agar). Plates were incubated overnight and pictures were taken of the resulting plates as well as colony counts for CFU.

Results

Successful inoculation of maize plants by the endophytic bacteria allowed the recovery of viable, culturable cells as identified on TSA agar plates. Controlled experiments using non-inoculated, surface sterilized seeds were conducted and showed few, if any, bacterial cells were cultivatable from the inside suggesting inoculation with extra microbes would be easily detectable by culturing. Non surface sterilized seeds meanwhile showed a large diversity of colony types including both bacteria and fungi which drowned out the detection by culturing of inoculated bacteria, whereas the plants grown from surface-sterilized seeds showed a dominance of the inoculated isolates readily identified by the colony morphology.

Finally, significant quantities of viable colonies were recovered from roots, shoots or seeds of maize plants inoculated with SYM00254, SYM00284, SYM00290, or SYM00292 (Table 7, FIG. 1a), confirming the successful colonization of these tissues of maize plants inoculated with the various isolates. Microbes living on the seed surface can be eliminated by surface sterilization as was done here. The elimination of this background allows for the quantitation of the cells of interest.

TABLE 7

Confirmed colonization of bacterial seed endophytes in maize shoot and root tissue at 7 days after seed inoculation.

| Seed microbes | Shoot tissue | Root tissue |
| --- | --- | --- |
| SYM00254 | ++ | +++ |
| SYM00284 | +++ | +++ |
| SYM00290 | + | +++ |
| SYM00292 | ++ | +++ |

+ - <10$^4$ cells per tissue type;
++ - 10$^4$ to 10$^6$ cells per tissue type;
+++ - >10$^6$ cells per tissue type.

Example 6—Testing of Bacterial Seed Endophyte Populations on Plants

The results shown above demonstrate that many of the endophytic bacteria described herein possess activities that could impart beneficial traits to a plant upon colonization. First, many of the bacteria described here are capable of producing compounds that could be beneficial to the plant, as detected using the in vitro assays described above. In addition, several representative bacteria were tested and found to successfully colonize maize plants as demonstrated in the example above. This section addresses the ability of the bacterial endophytes to confer beneficial traits on a host plant. Several different methods were used to ascertain this. First, plants inoculated with bacteria were tested under conditions without any stress to determine whether the microbe confers an increase in vigor. Second, endophyte-inoculated plants were tested under specific stress conditions (e.g., salt stress, heat stress, drought stress, and combinations thereof) to test whether the bacteria confer an increase in tolerance to these stresses. These growth tests were performed using three different means: using growth assays on water-agar plates; using growth assays on sterile filter papers; and growth assays in magenta boxes.

Description of Methods

Surface sterilization of seeds: non-treated organic maize (Blue River hybrids, 40R73), wheat (Briggs, developed by South Dakota State University) and soy (Butterbean (OG) (Johnny's) were sterilized overnight with chlorine gas as follows: 200 g of seeds were weighed and placed in a 250 mL glass bottle. The opened bottle and its cap were placed in a dessicator jar in a fume hood. A beaker containing 100 mL of commercial bleach (8.25% sodium hypochlorite) was placed in the dessicator jar. Immediately prior to sealing the jar, 3 mL of concentrated hydrochloric acid (34-37.5%) was carefully added to the bleach. The sterilization was left to proceed for 18-24 h. After sterilization, the bottle was closed with its sterilized cap, and reopened in a sterile flow hood. The opened bottle was left in the sterile hood for a couple hours to air out the seeds and remove chlorine gas leftover. The bottle was then closed and the seeds stored at room temperature in the dark until use.

Seedling Vigor Assessment in Normal and Stressed Conditions on Water Agar

Bacterial endophytes isolated from seeds as described herein were tested for their ability to promote plant growth under normal and stressed conditions by inoculating maize, wheat and soy seeds with those endophytes and germinating them on water agar. For each bacterial endophyte tested, 5 mL of liquid R2A medium was inoculated with a single colony and the culture grown at room temperature on a shaker to an OD (600 nm) of between 0.8 and 1.2.

For maize and wheat, sterilized seeds were placed on water agar plates (1.3% bacto agar) in a laminar flow hood, using forceps previously flamed. A drop of inoculum with an OD comprised between 0.8 and 1.2 (corresponding to about $10^8$ CFU $mL^{-1}$) was placed on each seed (50 µL for maize, 30 µL for wheat, representing approximately $5.10^6$ and $3.10^6$ CFU for maize and wheat, respectively). For soy, bacterial treatments were performed as follows: for each treatment, approximately 100 soybeans were placed in a 50 mL Falcon tube and 2 mL of inoculum with an OD comprised between 0.8 and 1.2 (corresponding to about $10^8$ CFU $mL^{-1}$) was pipetted into the tube representing approximately $2.10^6$ CFU per seed. After briefly shaking the tube to obtain uniform coverage of the seeds, soybeans were placed on water agar plates (1.3% or 0.6% bacto agar) in a laminar flow hood, using sterile forceps.

Figure 2:
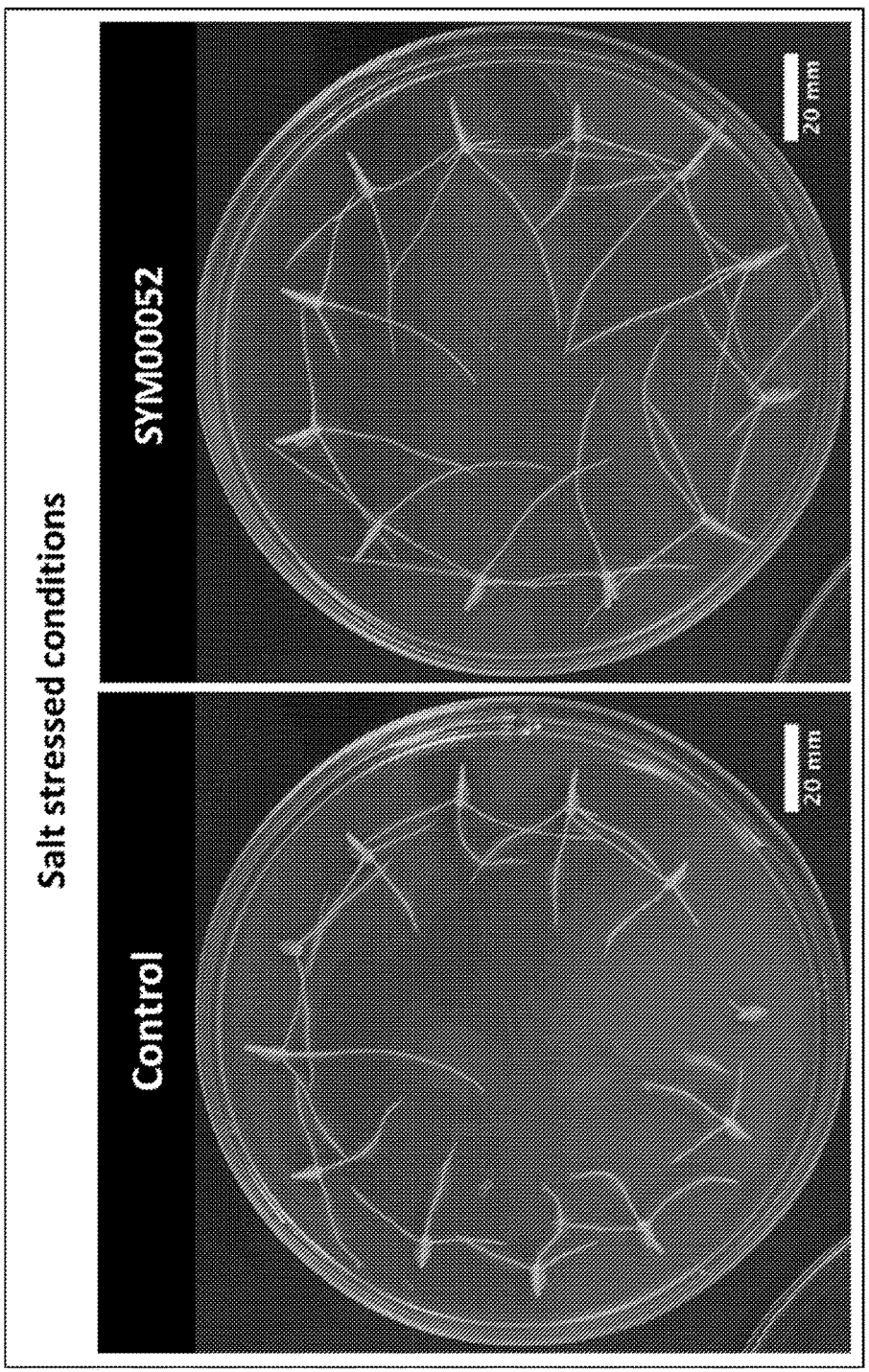
FIG. 2 contains representative photographs of wheat seedlings. The seedlings inoculated with SYM00052 (right) outperformed non-inoculated control seedlings (left) under salt stress conditions with 100 mM NaCl in the media. This provides an example of seed microbes conferring growth promotion to wheat seeds grown under salt stress.
Figure 3:
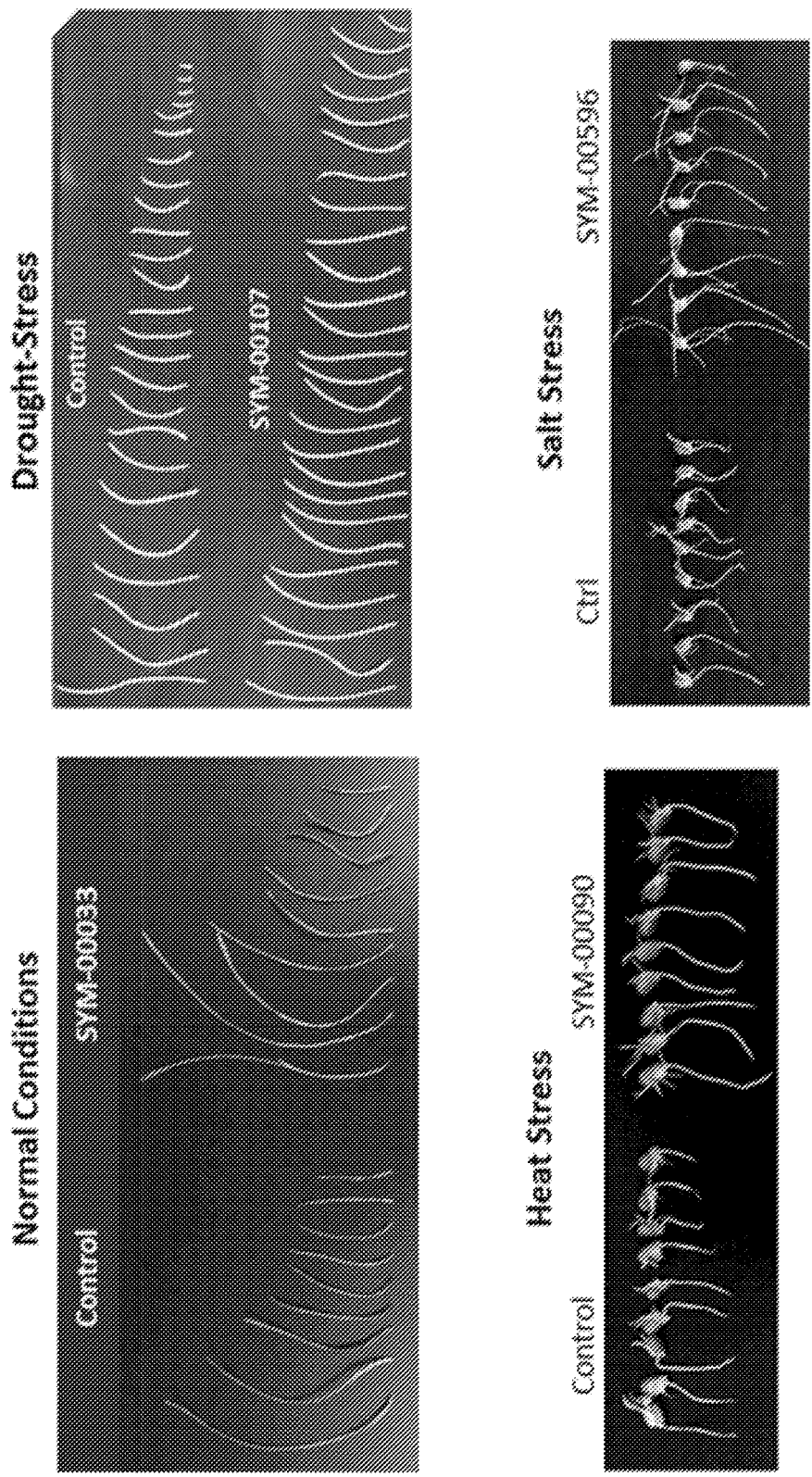
FIG. 3 contains representative photographs of seedlings under normal, drought stress, heat stress, or salt stress. Improved vigor or growth was observed in wheat (above) and corn (below) plants inoculated with seed bacterial endophytes. Top left: wheat seeds were inoculated with SYM00033 and germinated under normal conditions. Top right: wheat seedlings inoculated with SYM00107 show enhanced growth under drought stress compared to non-inoculated controls. Bottom left: SYM00090 inoculated corn seeds show improved growth under heat stress when compared with controls. Bottom right: corn seedlings inoculated with SYM00596 display enhanced growth under salt stress compared with controls.
Figure 4:
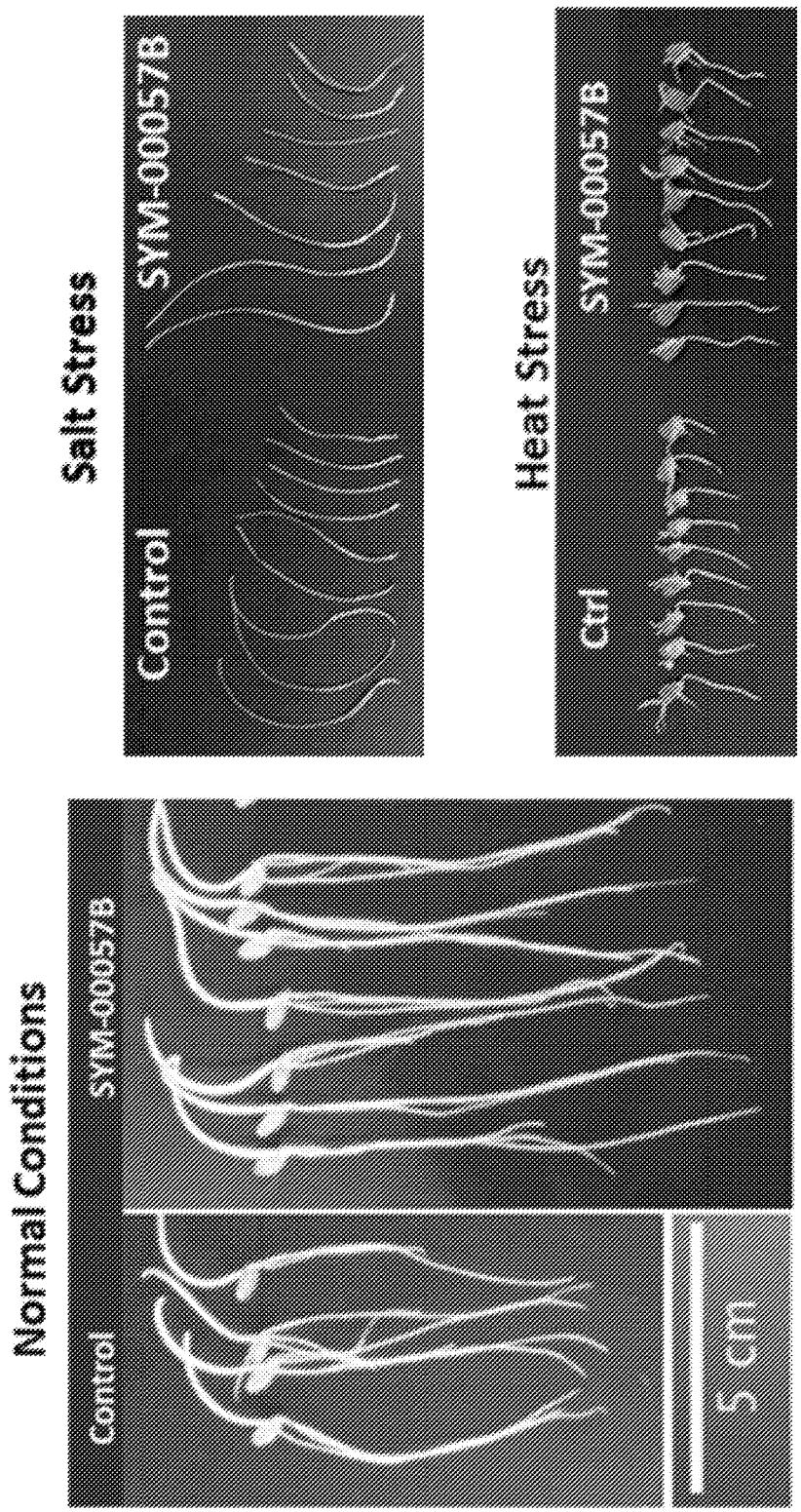
FIG. 4 contains representative photographs depicting seeds of wheat (Briggs cultivar) that were inoculated with the endophyte SYM00057B and grown under normal conditions (left), grown in the presence of 100 mM NaCl (top right), or under heat stress (bottom right). Increases in root length of wheat plants inoculated with seed endophytes were observed under normal conditions, and under salt and heat stress.
Figure 5:
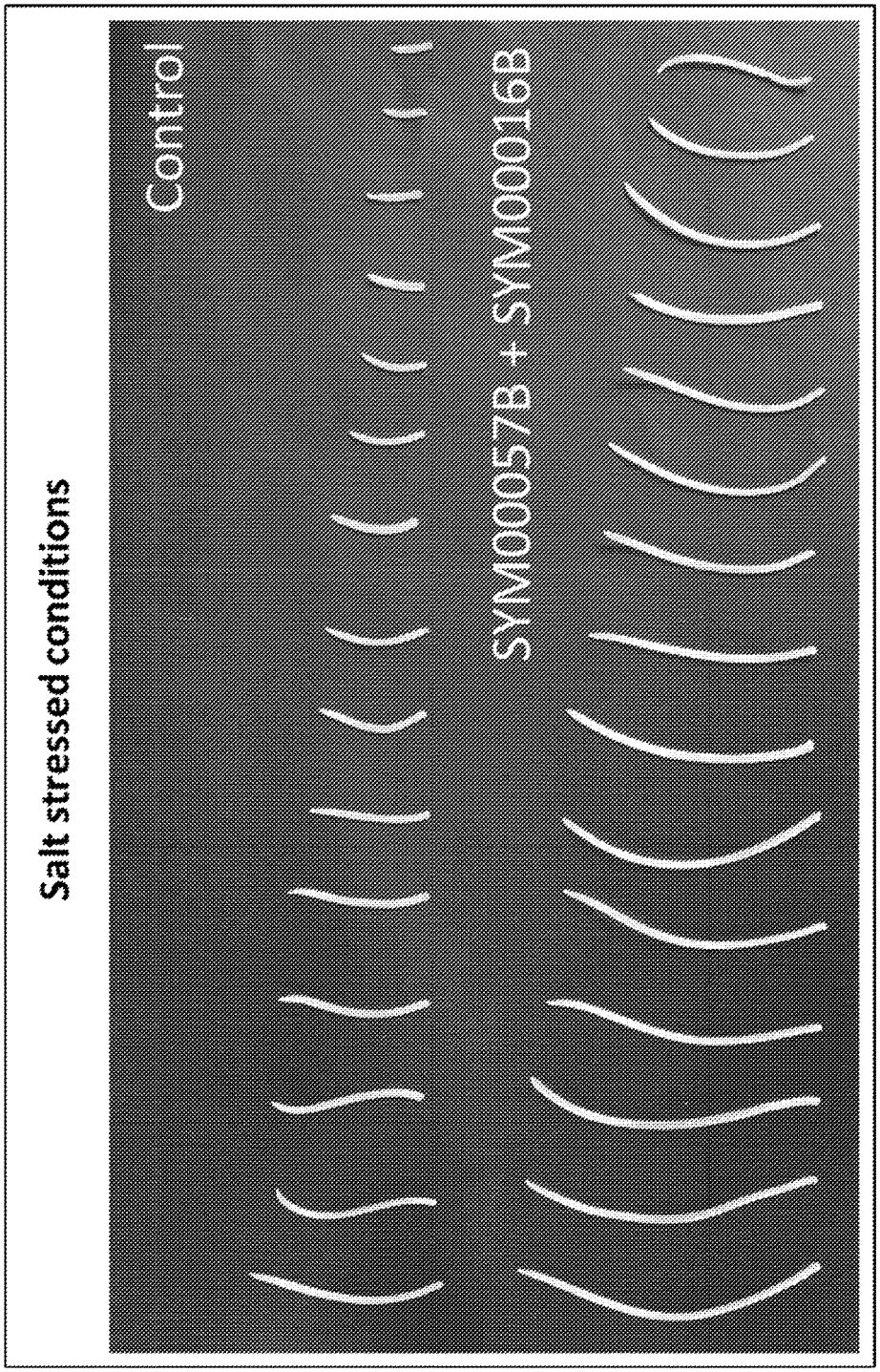
FIG. 5 contains representative photographs depicting the enhanced growth of wheat seeds after inoculation with a combination of SYM00057B and SYM00016B (bottom row) under salt stress conditions when compared with controls (top row). Combinations of seed endophytes confer improved vigor to wheat.
Figure 6:
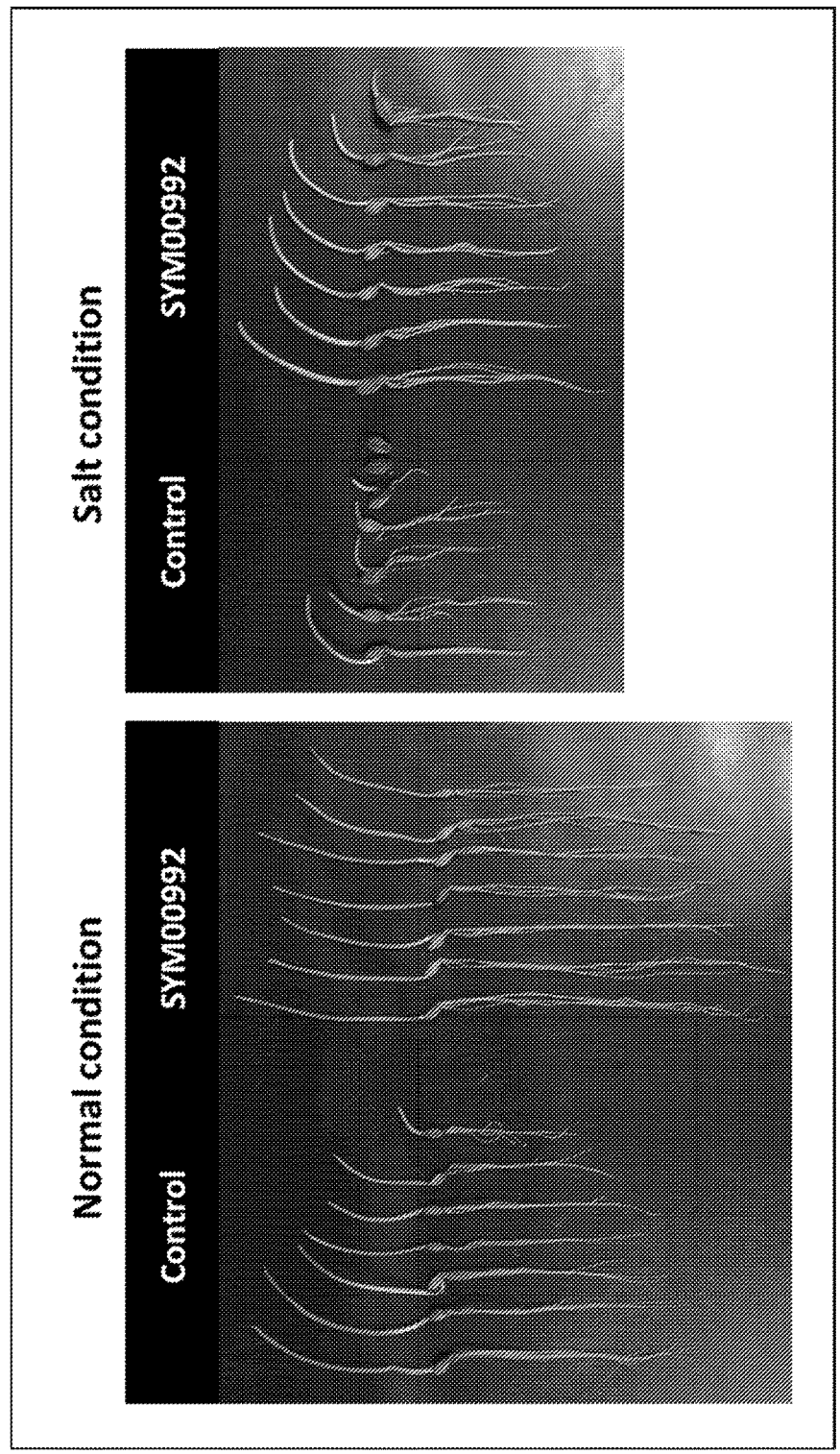
FIG. 6 contains representative photographs depicting barley seedlings (cultivars Robust and Conlon) inoculated with the endophyte SYM00992. The left panel shows an increase in shoot and root length under regular conditions and the right panel shows improved germination under salt stress conditions indicated that inoculation with a seed endophyte confers seedling vigor.

For each treatment, 3 plates were prepared with 12 (maize and wheat) or 9 (soy) seeds each, arranged as shown in FIG. 2 to insure position uniformity. Plates were sealed with surgical tape, randomized to avoid position effects and placed in a growth chamber set at 22° C., 60% relative humidity, in the dark for four days. After four days, plates were imaged for maize and wheat and the root length of each seedling was measured using the imaging software ImageJ. For soy, the radicles were detached from the seeds after 5 days, arranged on a black background, and imaged. Radicle length was then measured using the imaging software ImageJ. The percentage difference between the treated plants and the mock-treated (R2A control) was then calculated. For growth under salt stress, the water agar plates were supplemented with 100 mM (maize, wheat) or 50 mM (soy) NaCl. For growth under heat stress, the plates were placed at 40° C. (maize, wheat) or 35° C. (soy), 60% humidity after two (maize, wheat) or four (soy) days of growth, and left for an additional two (maize, wheat) or one (soy) day. For growth under drought, seedlings were grown on 0.6% water agar plates for 3 days, transferred to 1.3% water agar plates infused overnight with 20% PEG (6000) and grown for an additional 2 days.

Seedling Vigor Assays Under Normal and Stressed Conditions on Filter Paper

Filter papers were autoclaved and placed into Petri dishes, and then presoaked with treatment solutions. To simulate normal conditions, 3-4 mL sterile water was added to the filters. Drought and saline stresses were introduced by adding 3-4 mL 8% PEG 6000 solution or 50 or 100 mM NaCl to the filter papers, respectively. Heat stress was introduced to germinated seedlings after 2 days of incubation at 22° C. For maize and wheat, combined heat and saline stress was also tested. An appropriate volume of surface sterilized wheat and maize seeds were aliquoted into 50 mL conical tubes and incubated in enough bacterial inoculum to submerge seeds for at least one hour prior to plating. When testing barley, 1 mL bacterial inoculum was added to aliquots of seeds in 50 mL conical tubes and shaken for 10-20 seconds to coat seeds. For all three crops, nine seeds were plated in triplicate for each treatment in each condition tested. During initial stages of the experiment, plates were sealed with parafilm to inhibit evaporative water loss and premature drying of the filter papers. Plates were incubated in the dark at room temperature for two days following which heat treatment plates were shifted to 40° C. (maize and wheat) and 35° C. (barley) for 4-6 days. Parafilm was removed from all plates after 3-5 days. After 5-8 days, seedlings were scored by manually measuring root length for maize and shoot length for wheat and recording the mass of pooled maize and wheat seedlings from individual replicates. Two cultivars of barley (Robust and Conlon, Johnny's Selected Seeds) were subsequently tested on the filter paper platform. Robust seedling vigor was assessed by measuring root length and germination rate while only germination rates were assessed for Conlon seedlings.

Wheat (Briggs) and maize (Blue River Organic 40R3) seeds were surface-sterilized by exposure to chlorine gas and treated by soaking in bacterial cultures. Separate lots of seeds were treated by soaking in bacterial cultures (treatments) or fresh growth medium (control) for 1-2 hours prior to plating on filter papers pre-treated as described herein with water or 8% PEG 6000. Seeds were placed with their hilum contacting the filter paper on triplicate plates per treatment to maximize consistency within a bacterial treatment. Two sets of plates were prepared for each treatment. The first set was subjected to a short duration cold exposure of two days (cold shock) at 5-6° C. followed by four days at RT (room temperature) to allow seedling development. The second set was subjected to a longer duration cold exposure of 7 days (sustained cold) followed by 7 days at RT to allow seedling development. Seeds/seedlings were kept in the dark for the duration of the experiment. At the culmination of each RT incubation, seedling vigor was assessed by measuring shoot length (wheat), primary root length (maize) and seedling biomass (wheat and maize) of pooled seedlings from each replicate plate.

Results

Plant vigor and improved stress resilience are important components of providing fitness to a plant in an agricultural setting. These can be measured in germination assays to test the improvement on the plant phenotype as conferred by microbial inoculation. The collection of seed endophytes produced a measurable response in maize (Tables 8a, 8b and 8c), wheat (Table 9a and Table 9b), barley (Table 11a and 11b), and soy (Table 12) when inoculated as compared to non-inoculated controls. For example, from all the bacterial isolates representing 44 OTUs tested in these germination assays, >85% of 71 isolates tested in wheat, >80% of 69 isolates tested in corn and >97% of 49 isolates tested in soy produced a favorable phenotype in at least one of the measured multiple parameters such as root length, weight, or shoot length. This indicates that these heterologous seed endophyte-plant combinations exhibit improved fitness, including improved plant vigor and stress resilience relative to control host plants. Under normal conditions (vigor), for wheat, maize and soy respectively, 70%, 67% and 88% of the isolates tested showed some level of effect, and as high as 76% in soy exhibit a strong plant response. These results surprisingly indicate that the physiology and ecological niches of the endophyte collection can be associated with heterologous hosts to provide a high frequency of benefits.

The stress responses in the endophyte library can be seen by the ability of a subgroup to confer a beneficial response under different conditions such as heat, salt and drought. These can be applicable to products for arid and marginal lands. In a large proportion of cases for the tested isolates, the beneficial effect was measurable in all three crops indicating that these endophytes are capable of colonizing multiple varieties and plant species. For drought, 69%, 57% and 68% of the isolates improved the plant response in wheat, corn and soy respectively as measured by root length, shoot length or weight. For heat, 52%, 57% and 59% of the isolates improved the response in wheat, corn and soy respectively as measured by root length, shoot length or weight. Finally, in salt condition, 67%, 64% and 57% improved the response in wheat, corn and soy respectively as measured by root length, shoot length or weight. In some cases it was possible to see additive effects for stress responses comparing heat, salt and the combination of heat and salt in the same assay, however not always in a cumulative benefit.

For vigor in maize 81% of the isolates showed improvements when tested in filter paper or water agar assays. 40% of isolates tested stimulated increased root length in the barley cultivar Robust under normal conditions, and while fewer (27%) stimulated an increase in root length under drought stress, the growth promotion was more often greater in the drought condition compared to normal. Notably, 35% of the isolates tested increased germination rates under salt stress. Several endophytes showed benefit in normal and drought environments (Table 11a). For germination, 43% and 12% of isolates showed an improvement under normal and drought conditions, respectively (Table 11a). Germination rates were also measured in a second barley cultivar, Conlon. Compared to the control, profound increases in germination were observed in at least one condition for 53% of bacterial treatments, with 24% of treatments positively affecting germination under normal, 26% under saline, and 16% under drought conditions (Table 11b). The phenotypes conferred by the inoculation and improvement in plant development are visible by comparing for example the root length, shoot length and weight of the seedling with non-inoculated controls as illustrated in FIGS. 2-6.

Individual tests for stress response in maize showed in average 57% of the endophytes stimulated an increase in weight over control in heat and salt, 51% for heat-salt and 40% for drought on weight gain. For wheat under salt conditions 54% of the isolates produced an effect on root length, 77% of the isolates present a shoot length effect and 50% an increase in biomass. Drought tests were scored for shoot length and mass with 59% of the isolates showing increased shoot lengths and 43% an increase in biomass. When subjected to a cold shock during germination, two endophytes (SYM00090 and SYM00596) show strong increases in wheat and maize seedling vigor under normal conditions as measured through shoot length and root length respectively (Table 10). Specifically, after a two day cold shock SYM00090 and SYM00596 stimulated a 36% and 32% increase in wheat seedling shoot lengths, respectively, compared to the control, and after a 7 day cold shock those gains were improved to 63% and 45%, respectively. A similar pattern is observed in maize where a two day cold shock stimulated 16% (SYM00090) and 9% (SYM00596) increases in root length while a seven day cold shock further stimulated 80% and 56% increases in root length (Table 10).

Table 8.

Systematic assessment of effects of seed microbes on maize seedling vigor under normal and stressed conditions. Legend: "−" indicates no significant increase relative to non-inoculated control; "1"=0-5% increase relative to non-inoculated control; "2"=5-10% increase relative to non-inoculated control; "3"=>10% increase relative to non-inoculated control. Conditions; N=normal, S=salt, H=heat, H/S=heat and salt, D=drought.

TABLE 8(a)

Assessing organic maize for seedling vigor in water agar.

| | | Maize (cv. Blue River 40R73) Root Length | |
|---|---|---|---|
| SYM # | OTU | Normal | Salt |
| SYM00033 | 0 | — | — |
| SYM00176 | 0 | 1 | 1 |
| SYM00011 | 2 | — | 1 |
| SYM00167 | 3 | 1 | 1 |
| SYM00171 | 3 | — | |
| SYM00188 | 6 | 3 | — |
| SYM00190 | 6 | — | |
| SYM00017b | 7 | 2 | |
| SYM00049 | 7 | 3 | 1 |
| SYM00064a | 10 | 2 | 2 |
| SYM00028 | 18 | 2 | |
| SYM00052 | 18 | 1 | — |
| SYM00189 | 19 | 1 | |
| SYM00192 | 19 | 1 | 2 |
| SYM00016b | 25 | — | — |
| SYM00037 | 28 | — | |
| SYM00015 | 29 | — | |
| SYM00021 | 29 | — | |
| SYM00182 | 29 | | — |
| SYM00057b | 37 | 3 | 2 |
| SYM00102 | 38 | — | |
| SYM00075 | 39 | — | |
| SYM00249 | 39 | — | |
| SYM00017c | 45 | 3 | — |
| SYM00062B | 45 | 2 | |

TABLE 8(a)-continued

Assessing organic maize for seedling vigor in water agar.

| | | Maize (cv. Blue River 40R73) Root Length | |
|---|---|---|---|
| SYM # | OTU | Normal | Salt |
| SYM00231 | 46 | 2 | — |
| SYM00012 | 55 | 2 | 2 |
| SYM00046 | 56 | — | |
| SYM00050 | 56 | — | — |
| SYM00106 | 59 | — | |
| SYM00107 | 59 | — | |
| SYM00108 | 59 | — | |
| SYM00109 | 59 | — | |
| SYM00110 | 59 | — | |
| SYM00090 | 62 | — | 1 |
| SYM00002 | 66 | 2 | 2 |
| SYM00060 | 67 | 1 | |
| SYM00071 | 76 | 1 | |
| SYM00204 | 76 | 1 | |
| SYM00199 | 135 | 1 | 1 |
| SYM00212 | 135 | 1 | |
| SYM00172 | 146 | — | |

TABLE 8(b)

Assessing maize (commercial cultivar A) for seedling vigor in water agar.

| | | Maize (commercial cultivar A) | |
|---|---|---|---|
| SYM # | OTU | Weight Normal | Root length Normal |
| SYM00188 | 6 | | 1 |
| SYM00049 | 7 | 2 | 1 |
| SYM00075 | 39 | 2 | |
| SYM00017c | 45 | | 1 |

TABLE 8(c)

Assessing maize for seedling vigor on filter paper.

| | | Maize (cv. Blue River 40R73) on filter paper | | | | | | | | | |
|---|---|---|---|---|---|---|---|---|---|---|---|
| | | Root length | | | | | Seedling weight | | | | |
| SYM # | OTU | N | H | S | H/S | D | N | H | S | H/S | D |
| SYM00033 | 0 | — | 1 | 3 | 2 | 3 | 1 | 3 | — | 2 | — |
| SYM00173 | 0 | | | | | | | | | | |
| SYM00176 | 0 | | | | 1 | | | | | 1 | |
| SYM00284 | 0 | 3 | — | | | 1 | | | | | 1 |
| SYM00660 | 1 | — | 2 | 1 | 1 | 2 | — | 2 | — | — | 2 |
| SYM00011 | 2 | | | | 2 | | | | | | 2 |
| SYM00068 | 2 | 3 | — | — | 3 | 1 | 1 | — | — | 2 | — |
| SYM00167 | 3 | 2 | 2 | 1 | 3 | 3 | 1 | 3 | — | 2 | — |
| SYM00188 | 6 | — | 1 | 2 | — | — | 1 | 2 | 1 | 3 | — |
| SYM00292 | 6 | 3 | — | | 3 | — | | | | | 1 |
| SYM00049 | 7 | 1 | 3 | 1 | 2 | 3 | — | — | — | 1 | — |
| SYM00967 | 8 | — | — | 3 | — | 3 | 1 | 1 | 1 | 1 | 1 |
| SYM00596 | 9 | 1 | 3 | 3 | 3 | 1 | — | 3 | — | 3 | — |
| SYM00064a | 10 | — | | | | | | | | | |
| SYM00595 | 12 | 1 | 3 | 2 | 2 | — | 1 | 3 | 1 | 3 | — |
| SYM00547 | 13 | 2 | 1 | 3 | — | 1 | 1 | — | — | — | 1 |
| SYM00028 | 18 | | | | 3 | 1 | — | 2 | 3 | — | |
| SYM00052 | 18 | | | | 2 | — | — | — | — | — | 1 |
| SYM00192 | 19 | — | 2 | — | 3 | — | 1 | 2 | 1 | 3 | — |
| SYM00260 | 19 | 3 | — | | 3 | 1 | — | | | | 2 |
| SYM00016b | 25 | 1 | — | 2 | — | — | — | 1 | — | 1 | — |
| SYM00501 | 27 | — | — | — | — | — | — | — | — | — | — |
| SYM00051 | 28 | | | | | | | | | | |
| SYM00021 | 29 | — | — | 3 | 1 | — | — | — | — | — | — |
| SYM00182 | 29 | | | | | | | | | 1 | — |
| SYM00775 | 30 | — | — | 3 | — | — | 2 | 2 | — | 3 | 2 |
| SYM00589 | 31 | 3 | 2 | 3 | 1 | — | — | — | — | — | — |
| SYM00991 | 36 | — | — | — | 3 | — | 1 | — | — | — | 1 |
| SYM00057b | 37 | 1 | 1 | — | 1 | 3 | 1 | 3 | 1 | 1 | 1 |
| SYM00102 | 38 | — | 2 | 3 | 3 | — | — | 1 | — | 3 | — |
| SYM00072 | 39 | — | — | — | — | — | 1 | — | — | 1 | 1 |
| SYM00075 | 39 | | | | | | — | — | — | — | 3 |
| SYM00218 | 41 | | | | | | — | — | 1 | — | 3 |
| SYM00017c | 45 | 1 | — | 3 | 2 | 3 | — | 1 | 1 | 2 | — |
| SYM00231 | 46 | | | | | | — | — | 1 | — | 1 |
| SYM00975 | 51 | 2 | — | 3 | — | 3 | 1 | 1 | — | — | 2 |
| SYM00554 | 53 | — | 3 | — | 3 | — | — | 1 | — | 3 | — |
| SYM00012 | 55 | — | 1 | — | — | — | 2 | 2 | — | 2 | — |
| SYM00050 | 56 | | | | | 3 | — | — | — | — | — |
| SYM00106 | 59 | — | 2 | 1 | 3 | — | 2 | 2 | 1 | 3 | — |
| SYM00107 | 59 | — | 1 | — | — | — | 1 | — | — | 3 | 1 |
| SYM00254 | 59 | 1 | — | | | | — | 1 | — | — | 2 |
| SYM00090 | 62 | 2 | 2 | 2 | — | 3 | 3 | 3 | 1 | 1 | — |
| SYM00002 | 66 | 1 | 3 | — | — | 3 | 2 | 3 | 1 | — | 1 |
| SYM00060 | 67 | 3 | 2 | 1 | — | — | — | 2 | — | — | — |
| SYM00071 | 76 | — | 1 | 2 | 3 | — | 2 | 1 | 2 | 3 | — |
| SYM00940 | 83 | — | — | — | — | 1 | 1 | 1 | — | — | 1 |
| SYM00713 | 84 | — | — | — | — | 2 | — | — | — | — | — |
| SYM00992 | 126 | 1 | — | — | — | 3 | — | — | — | — | — |
| SYM00063 | 134 | — | — | — | — | — | 1 | 1 | — | — | — |
| SYM00199 | 135 | — | 3 | — | 3 | — | 1 | 3 | 1 | 3 | — |
| SYM00172 | 146 | — | — | — | 1 | — | — | — | — | — | — |
| SYM00538A | 172 | 1 | 1 | 3 | — | — | — | — | — | 1 | — |
| SYM00508 | 196 | — | — | — | — | — | 1 | — | — | — | — |

Table 9.

Assessing wheat seedling vigor under abiotic stresses.

TABLE 9(a)

Wheat (cv. Briggs) seedling vigor assessment using water agar.

| | | Root Length Wheat (cv. Briggs) on water agar | | |
|---|---|---|---|---|
| SYM # | OTU | Normal | Heat | Salt |
| SYM00033 | 0 | 3 | — | 3 |
| SYM00173 | 0 | — | — | — |
| SYM00176 | 0 | 2 | — | — |
| SYM00660 | 1 | — | — | 2 |
| SYM00011 | 2 | 3 | 3 | 3 |
| SYM00167 | 3 | 3 | — | 3 |
| SYM00171 | 3 | — | | |
| SYM00188 | 6 | 1 | — | — |
| SYM00190 | 6 | 3 | | |
| SYM00292 | 6 | — | — | 2 |
| SYM00017b | 7 | — | | |
| SYM00049 | 7 | 3 | 2 | 2 |
| SYM00967 | 8 | 2 | 3 | 3 |
| SYM00596 | 9 | 1 | 3 | 1 |
| SYM00064a | 10 | 3 | — | — |
| SYM00183 | 10 | 3 | — | — |
| SYM00595 | 12 | — | 3 | — |
| SYM00547 | 13 | 2 | 3 | 2 |
| SYM00028 | 18 | 3 | | |
| SYM00052 | 18 | 1 | — | 3 |
| SYM00189 | 19 | — | | |
| SYM00192 | 19 | 3 | 1 | — |
| SYM00016b | 25 | 2 | 3 | 3 |
| SYM00501 | 27 | — | — | — |
| SYM00037 | 28 | 1 | — | — |
| SYM00051 | 28 | — | — | — |
| SYM00015 | 29 | — | 1 | — |
| SYM00021 | 29 | 3 | | |

TABLE 9(a)-continued

Wheat (cv. Briggs) seedling vigor assessment using water agar.

| SYM # | OTU | Root Length Wheat (cv. Briggs) on water agar | | |
|---|---|---|---|---|
| | | Normal | Heat | Salt |
| SYM00182 | 29 | 2 | — | — |
| SYM00775 | 30 | — | 2 | — |
| SYM00589 | 31 | — | 3 | 1 |
| SYM00991 | 36 | — | — | — |
| SYM00057b | 37 | 3 | 3 | 3 |
| SYM00102 | 38 | 2 | — | — |
| SYM00072 | 39 | 2 | 3 | — |
| SYM00075 | 39 | 3 | — | — |
| SYM00249 | 39 | 1 | | |
| SYM00110 | 41 | — | | |
| SYM00193 | 41 | — | | |
| SYM00218 | 41 | 3 | 1 | — |
| SYM00017c | 45 | 3 | 2 | 3 |
| SYM00062b | 45 | — | | |
| SYM00168 | 45 | 3 | — | 1 |
| SYM00231 | 46 | — | — | — |
| SYM00975 | 51 | 1 | — | 2 |
| SYM00554 | 53 | — | — | — |
| SYM00012 | 55 | 3 | 1 | 3 |
| SYM00046 | 56 | 3 | | |
| SYM00050 | 56 | 1 | 1 | — |
| SYM00106 | 59 | — | — | — |
| SYM00107 | 59 | 2 | 3 | — |
| SYM00108 | 59 | — | | |
| SYM00090 | 62 | 3 | 2 | 1 |
| SYM00002 | 66 | 3 | — | 3 |
| SYM00060 | 67 | 2 | | |
| SYM00071 | 76 | 3 | | |
| SYM00204 | 76 | 1 | | |
| SYM00965 | 82 | 2 | — | 1 |
| SYM00940 | 83 | — | 1 | — |
| SYM00713 | 84 | 2 | — | 1 |
| SYM00992 | 126 | — | — | 3 |
| SYM00063 | 134 | 1 | — | — |
| SYM00199 | 135 | 3 | 1 | 3 |
| SYM00212 | 135 | 1 | | |
| SYM00172 | 146 | — | — | — |
| SYM00538A | 172 | 1 | — | 1 |
| SYM00508 | 196 | 3 | 3 | 1 |

Legend:
"—" indicates no significant increase relative to non-inoculated control;
"1" = 0-5% increase relative to non-inoculated control;
"2" = 5-10% increase relative to non-inoculated control;
"3" = >10% increase relative to non-inoculated control.

TABLE 9(b)

Wheat (cv. Briggs) seedling vigor assessment using filter paper assay.

| SYM # | OTU | Wheat (cv. Briggs) on filter paper | | | | | |
|---|---|---|---|---|---|---|---|
| | | Shoot length | | | Weight | | |
| | | N | S | D | N | S | D |
| SYM00033 | 0 | 3 | 1 | 2 | — | — | 1 |
| SYM00173 | 0 | — | — | — | 1 | — | — |
| SYM00176 | 0 | 2 | 1 | 2 | — | 1 | 1 |
| SYM00284 | 0 | 3 | — | 3 | 3 | — | — |
| SYM00660 | 1 | — | — | 3 | — | — | — |
| SYM00011 | 2 | 3 | 1 | 3 | 3 | — | 2 |
| SYM00068 | 2 | 1 | 1 | 2 | — | — | 1 |
| SYM00167 | 3 | 2 | 2 | 1 | — | 1 | 2 |
| SYM00188 | 6 | 1 | 3 | — | — | 3 | 1 |
| SYM00292 | 6 | — | — | — | — | — | — |
| SYM00049 | 7 | 3 | — | 3 | 2 | — | 2 |
| SYM00967 | 8 | — | — | — | — | — | — |
| SYM00596 | 9 | 1 | 3 | 3 | 1 | 3 | 2 |
| SYM00064a | 10 | — | 2 | 2 | — | — | — |
| SYM00595 | 12 | 1 | 3 | 3 | 2 | 3 | — |
| SYM00547 | 13 | | | 1 | | | — |
| SYM00028 | 18 | — | 3 | 3 | 1 | 3 | 3 |
| SYM00052 | 18 | 1 | — | 1 | 3 | 1 | — |
| SYM00192 | 19 | — | 3 | — | 2 | 3 | — |
| SYM00260 | 19 | — | — | 3 | | | |
| SYM00016b | 25 | 3 | — | 2 | 1 | — | 1 |
| SYM00501 | 27 | | | — | | | — |
| SYM00021 | 29 | 3 | — | 2 | — | 1 | 1 |
| SYM00182 | 29 | — | — | 3 | — | — | 1 |
| SYM00775 | 30 | | | — | | | — |
| SYM00589 | 31 | — | — | — | — | 1 | — |
| SYM00991 | 36 | | | — | | | — |
| SYM00057b | 37 | 3 | 3 | 1 | 2 | — | 3 |
| SYM00102 | 38 | — | 3 | 3 | 2 | 3 | 1 |
| SYM00072 | 39 | — | — | 1 | 1 | 1 | — |
| SYM00075 | 39 | — | 1 | 3 | — | — | 3 |
| SYM00218 | 41 | — | 2 | 3 | 3 | — | 3 |
| SYM00017c | 45 | — | 1 | — | — | 1 | 2 |
| SYM00168 | 45 | 3 | — | 3 | 1 | — | 1 |
| SYM00231 | 46 | — | — | 3 | 3 | 3 | 3 |
| SYM00975 | 51 | | | — | | | — |
| SYM00554 | 53 | — | 3 | — | — | 3 | — |
| SYM00012 | 55 | — | 2 | 3 | 2 | — | 1 |
| SYM00046 | 56 | — | — | — | — | — | — |
| SYM00050 | 56 | 2 | — | — | 3 | — | — |
| SYM00106 | 59 | 1 | 3 | 3 | — | 3 | 3 |
| SYM00107 | 59 | 1 | 3 | 3 | 2 | 3 | 3 |
| SYM00254 | 59 | — | — | 3 | | | |
| SYM00090 | 62 | — | — | 3 | — | — | 3 |
| SYM00002 | 66 | — | 1 | — | — | 2 | — |
| SYM00071 | 76 | 2 | 3 | 3 | — | 3 | 1 |
| SYM00940 | 83 | | | — | | | — |
| SYM00713 | 84 | — | — | 1 | — | — | — |
| SYM00992 | 126 | | | — | | | — |
| SYM00199 | 135 | — | — | 1 | 2 | — | — |
| SYM00172 | 146 | — | — | — | — | — | 3 |
| SYM00508 | 196 | — | 3 | — | — | 1 | — |

Legend: "—" indicates no increase relative to non-inoculated control; "1" = 0-5% increase; "2" = 5-10% increase; "3" = >10% increase.
Conditions; N = normal, S = salt, D = drought.

TABLE 10

Wheat and maize response to cold exposure when treated with seed bacterial isolates.

| | | Wheat | | | | | | Maize | | | | |
| | | 2 d N | | 2 d D | | 7 d N | | 2 d N | | 2 d D | | 7 d N | |
| SYM # | OTU | R | % | R | % | R | % | R | % | R | % | R | % |
|---|---|---|---|---|---|---|---|---|---|---|---|---|---|
| SYM00596 | 9 | 3 | 31 | 3 | 41 | 3 | 45 | 2 | 9 | 0 | -4 | 3 | 56 |
| SYM00090 | 62 | 3 | 35 | 3 | 23 | 3 | 63 | 3 | 14 | 2 | 7 | 3 | 80 |

Legend:
"—" indicates no significant increase relative to non-inoculated control;
"1" = 0-5% increase relative to non-inoculated control;
"2" = 5-10% increase relative to non-inoculated control;
"3" = >10% increase relative to non-inoculated control.
R = ranking,
% = percent change relative to control.
Conditions;
N = normal,
D = drought.
Number followed by "d" = days in cold stress condition.

Table 11.
Barley seedling responses to abiotic stresses.

TABLE 11(a)

Barley seedling vigor as indicated by germination and root length in cultivar Robust as a response to abiotic stress while growing on moistened filter paper.

| | | Barley (cv. Robust) on filter paper | | | | | |
| | | Root length | | | Germination | | |
| SYM # | OTU | N | S | D | N | S | D |
|---|---|---|---|---|---|---|---|
| SYM00033 | 0 | — | — | — | — | — | — |
| SYM00660 | 1 | — | — | — | — | — | — |
| SYM00011 | 2 | — | — | — | — | — | 1 |
| SYM00167 | 3 | — | — | — | — | — | — |
| SYM00188 | 6 | — | — | — | 2 | 2 | — |
| SYM00049 | 7 | — | — | — | — | — | — |
| SYM00967 | 8 | — | — | — | 2 | 1 | — |
| SYM00596 | 9 | — | — | 1 | — | — | — |
| SYM00064a | 10 | — | — | — | — | — | — |
| SYM00595 | 12 | — | — | 1 | 3 | 3 | — |
| SYM00547 | 13 | — | — | — | — | — | — |
| SYM00028 | 18 | 2 | — | 2 | — | — | — |
| SYM00052 | 18 | — | — | — | — | — | — |
| SYM00192 | 19 | — | — | — | 1 | — | 2 |
| SYM00016b | 25 | — | — | — | — | — | 1 |
| SYM00501 | 27 | — | — | — | — | — | — |
| SYM00051 | 28 | — | — | — | 1 | — | — |
| SYM00021 | 29 | — | — | 2 | — | — | — |
| SYM00775 | 30 | 1 | — | 2 | 3 | 3 | — |
| SYM00589 | 31 | — | — | — | 3 | 2 | — |
| SYM00991 | 36 | 1 | — | — | 3 | 1 | — |
| SYM00057b | 37 | — | — | — | — | 1 | — |
| SYM00102 | 38 | 1 | — | — | — | 3 | — |
| SYM00075 | 39 | 1 | — | — | 2 | — | 1 |
| SYM00218 | 41 | — | — | 1 | 3 | 3 | — |
| SYM00017c | 45 | — | — | — | — | — | — |
| SYM00168 | 45 | 2 | — | — | 2 | — | — |
| SYM00231 | 46 | — | — | — | 2 | 2 | — |
| SYM00975 | 51 | 3 | — | 3 | 1 | — | — |
| SYM00554 | 53 | — | — | — | 2 | 2 | — |
| SYM00012 | 55 | 1 | — | — | — | 3 | 3 |
| SYM00046 | 56 | — | — | — | — | — | — |
| SYM00107 | 59 | 2 | — | 2 | — | — | — |
| SYM00090 | 62 | — | 3 | — | — | 1 | 1 |
| SYM00002 | 66 | — | 1 | — | — | — | — |
| SYM00060 | 67 | — | — | — | 3 | 2 | — |
| SYM00071 | 76 | 1 | — | — | 1 | — | — |
| SYM00965 | 82 | — | — | — | 3 | 3 | — |
| SYM00940 | 83 | — | — | 1 | 3 | 1 | — |
| SYM00713 | 84 | — | — | — | — | — | — |
| SYM00992 | 126 | 3 | — | 2 | 3 | 1 | — |
| SYM00063 | 134 | — | — | — | — | — | — |
| SYM00199 | 135 | — | — | — | 3 | — | — |
| SYM00172 | 146 | — | — | — | — | — | — |
| SYM00508 | 196 | — | — | — | — | — | — |

Legend: "—" indicates no increase relative to non-inoculated control; "1" = 0-5% increase; "2" = 5-10% increase; "3" = >10% increase.
Conditions; N = normal, S = salt, D = drought.

TABLE 11(b)

Barley seedling vigor as indicated by germination in cultivar Conlon as a response to abiotic stress while growing on moistened filter paper.

| | | Barley (cv. Conlon) on filter paper | | |
| SYM # | OTU | N | S | D |
|---|---|---|---|---|
| SYM00033 | 0 | 3 | — | — |
| SYM00660 | 1 | — | — | — |
| SYM00011 | 2 | — | — | — |
| SYM00167 | 3 | — | — | — |
| SYM00188 | 6 | — | 3 | — |
| SYM00049 | 7 | 2 | — | 2 |
| SYM00967 | 8 | — | — | — |
| SYM00596 | 9 | — | 3 | — |
| SYM00064a | 10 | — | — | — |
| SYM00595 | 12 | — | — | — |
| SYM00547 | 13 | — | — | — |
| SYM00028 | 18 | 3 | — | — |
| SYM00052 | 18 | — | — | — |
| SYM00192 | 19 | — | — | — |
| SYM00016b | 25 | 1 | 3 | — |
| SYM00501 | 27 | — | — | — |
| SYM00051 | 28 | — | — | — |
| SYM00021 | 29 | — | — | — |
| SYM00775 | 30 | — | — | — |
| SYM00589 | 31 | — | — | — |
| SYM00991 | 36 | 1 | — | 2 |
| SYM00057b | 37 | — | 2 | — |
| SYM00102 | 38 | — | 3 | 2 |
| SYM00075 | 39 | 3 | — | 3 |

TABLE 11(b)-continued

Barley seedling vigor as indicated by germination in cultivar Conlon as a response to abiotic stress while growing on moistened filter paper.

| | | Barley (cv. Conlon) on filter paper | | |
|---|---|---|---|---|
| SYM # | OTU | N | S | D |
| SYM00218 | 41 | — | — | — |
| SYM00017c | 45 | — | — | — |
| SYM00168 | 45 | — | — | — |
| SYM00231 | 46 | — | — | — |
| SYM00975 | 51 | — | — | — |
| SYM00554 | 53 | — | 2 | — |
| SYM00012 | 55 | 1 | 3 | 2 |
| SYM00046 | 56 | — | — | — |
| SYM00107 | 59 | — | — | 3 |
| SYM00090 | 62 | — | 3 | — |
| SYM00002 | 66 | — | — | — |
| SYM00060 | 67 | — | — | — |
| SYM00071 | 76 | 3 | 3 | 2 |
| SYM00965 | 82 | — | 3 | — |
| SYM00940 | 83 | — | — | — |
| SYM00713 | 84 | — | — | — |
| SYM00992 | 126 | — | 3 | — |
| SYM00063 | 134 | 3 | — | — |
| SYM00199 | 135 | — | 3 | — |
| SYM00172 | 146 | — | — | — |
| SYM00508 | 196 | 2 | — | — |

Legend:
"—" indicates no increase relative to non-inoculated control;
"1" = 0-5% increase;
"2" = 5-10% increase;
"3" = >10% increase.
Conditions; N = normal, S = salt, D = drought.

TABLE 12

Soy seedling vigor assessment using water agar assay.

| | | Soy (cv. Butterbean) on water agar | | | | |
|---|---|---|---|---|---|---|
| | | 1.3% water agar | | 0.6% water agar | | |
| SYM # | OTU | N | H | N | S | H | D |
| SYM00033 | 0 | 3 | 3 | 3 | 3 | 3 | 3 |
| SYM00176 | 0 | 3 | 3 | — | 3 | | |
| SYM00660 | 1 | — | — | 2 | 1 | | — |
| SYM00011 | 2 | — | — | — | — | 3 | — |
| SYM00167 | 3 | 3 | 2 | 3 | — | | 1 |
| SYM00188 | 6 | — | — | 3 | 3 | 3 | 1 |
| SYM00017B | 7 | 3 | 3 | — | 3 | | — |
| SYM00049 | 7 | 3 | — | — | 3 | | 3 |
| SYM00967 | 8 | 3 | — | 1 | 2 | | 2 |
| SYM00596 | 9 | 3 | — | 3 | — | | 3 |
| SYM00064a | 10 | 3 | 3 | 2 | 1 | | 3 |
| SYM00595 | 12 | 3 | — | 3 | 3 | | 3 |
| SYM00547 | 13 | 3 | — | 2 | — | | — |
| SYM00028 | 18 | 3 | 3 | 1 | — | | 3 |
| SYM00052 | 18 | 3 | 3 | 1 | — | | — |
| SYM00192 | 19 | 1 | — | | | | |
| SYM00016b | 25 | 2 | — | — | 1 | 3 | — |
| SYM00501 | 27 | — | — | — | — | | — |
| SYM00051 | 28 | 3 | 3 | 1 | 1 | | 3 |
| SYM00021 | 29 | 3 | 3 | — | 2 | | 1 |
| SYM00775 | 30 | — | — | 1 | 3 | | 3 |
| SYM00589 | 31 | 3 | — | — | 2 | | 3 |
| SYM00991 | 36 | — | — | — | — | | 1 |
| SYM00057b | 37 | 3 | 1 | — | 2 | 3 | — |
| SYM00102 | 38 | 3 | — | — | 3 | 3 | — |
| SYM00072 | 39 | 3 | 1 | 1 | — | | 3 |
| SYM00075 | 39 | 3 | 1 | — | — | | — |
| SYM00218 | 41 | 3 | — | 1 | 3 | | 2 |
| SYM00017c | 45 | 3 | 3 | 1 | — | 3 | 1 |
| SYM00168 | 45 | 3 | — | — | 1 | | 2 |
| SYM00231 | 46 | 1 | — | — | — | | 1 |
| SYM00975 | 51 | 3 | 1 | 1 | 3 | | 2 |
| SYM00554 | 53 | 3 | — | — | 1 | | 3 |
| SYM00012 | 55 | — | 3 | — | 2 | | — |
| SYM00046 | 56 | 3 | 3 | 1 | — | | — |
| SYM00050 | 56 | 3 | 3 | 3 | — | | 2 |
| SYM00107 | 59 | 1 | 3 | — | — | | 1 |
| SYM00090 | 62 | — | — | — | — | 2 | — |
| SYM00002 | 66 | 3 | 3 | 1 | 3 | | 3 |
| SYM00060 | 67 | 3 | 1 | 3 | 3 | | 3 |
| SYM00071 | 76 | 3 | 3 | 2 | 2 | | 3 |
| SYM00965 | 82 | 3 | — | 2 | — | | — |
| SYM00940 | 83 | 3 | 1 | — | — | | 3 |
| SYM00713 | 84 | 3 | — | — | 3 | | 3 |
| SYM00992 | 126 | — | — | — | 3 | | 3 |
| SYM00063 | 134 | 3 | 3 | — | — | | 2 |
| SYM00199 | 135 | 3 | — | 1 | 3 | | 2 |
| SYM00172 | 146 | 3 | — | | | | |
| SYM00508 | 196 | 3 | 3 | — | — | | 2 |

Legend:
"—" indicates no significant increase relative to non-inoculated control;
"1" = 0-5% increase relative to non-inoculated control;
"2" = 5-10% increase relative to non-inoculated control;
"3" = >10% increase relative to non-inoculated control.
Conditions;
N = normal,
H = heat,
S = salt,
D = drought.

Growth Test of Inoculated Plants in Magenta Boxes

Representative endophytes isolated from seeds as described herein were tested for their ability to promote plant growth under normal and stressed conditions by inoculating maize seeds with those endophytes and growing them inside Conviron Growth chambers (Conviron Corp., Asheville, N.C.) on double-decker Magenta boxes essentially as described by Rodriguez and colleagues (ISME Journal 2(4): 404-416 (2008). Briefly, the double-deckers were made by drilling a hole 8 mm in diameter in the center of a GA-7 plant culture vessel (Magenta boxes, Sigma, St. Louis), top-knotting and weaving through a 14 cm length of cotton rope to the bottom chamber to act as a wick and adding a defined amount of playground sand in the upper chamber. Peter's 20-20-20 plant nutrient solution (Peters Fertilizer Co., Fogelsville, Pa.) is added to the bottom chamber and a tight-fitting lid is added to the top and the whole system autoclaved and sterilized prior to planting with not-inoculated or endophyte-treated seeds.

Maize seeds were surface sterilized with chlorine gas as described herein. Sterilized maize seeds were soaked for one hour on the appropriate bacterial culture before planting. Each bacterial culture was grown on a shaking incubator 20% Tryptic soy broth (TSB) until reaching ~0.5 optical density, measured at 600 nm wavelength. Non-inoculated controls were soaked on sterile 20% TSB. Three seeds were planted on each double-decker Magenta box and three boxes were used per treatment (endophytic bacteria×environmental condition). The double-deckers were placed inside a Conviron Growth chamber with a setting of 60% humidity and kept in the dark for four days, until they started germinating. Upon germination, plants were grown in a cycle of light (~400 mE×m$^{-2}$×s$^{-1}$) for 14 h and dark for 10 h. When the leaves were fully expanded, approximately 8 days after seeding, the plants were assigned to one of 3 chambers were conditions were as follows: for control conditions, plants were kept at 22° C.; for cold, plants were subjected to 5° C. during the light part of the daily cycle and near zero degrees centigrade during the dark part; for drought, the plants were maintained in the control chamber, but the liquid from the lower part of the double decker was emptied and the soil was allowed to dry; for heat conditions, the light intensity was set to a maximum of ~600 mE×m$^{-2}$×s$^{-1}$, while the temperature was set to 40° C. for 12 h out of the 14 h of light and 45 degrees during the two h around noon, during the dark cycle the temperature was set to 30° C. The air humidity was maintained at 60% in all chambers. The conditions were maintained for one week at the end of which conductance was measured using an SC-1 Leaf Porometer (Decagon Devices Inc., Pullman, Wash.) in the plants maintained under control and drought conditions and all the plants were harvested, photographed and dried in a convention oven at 45° C. to estimate dried biomass. Shoot and root lengths were measured digitally using the software ImageJ version 1.48u4 (Rasband imagej.nih.gov).

Figure 7:
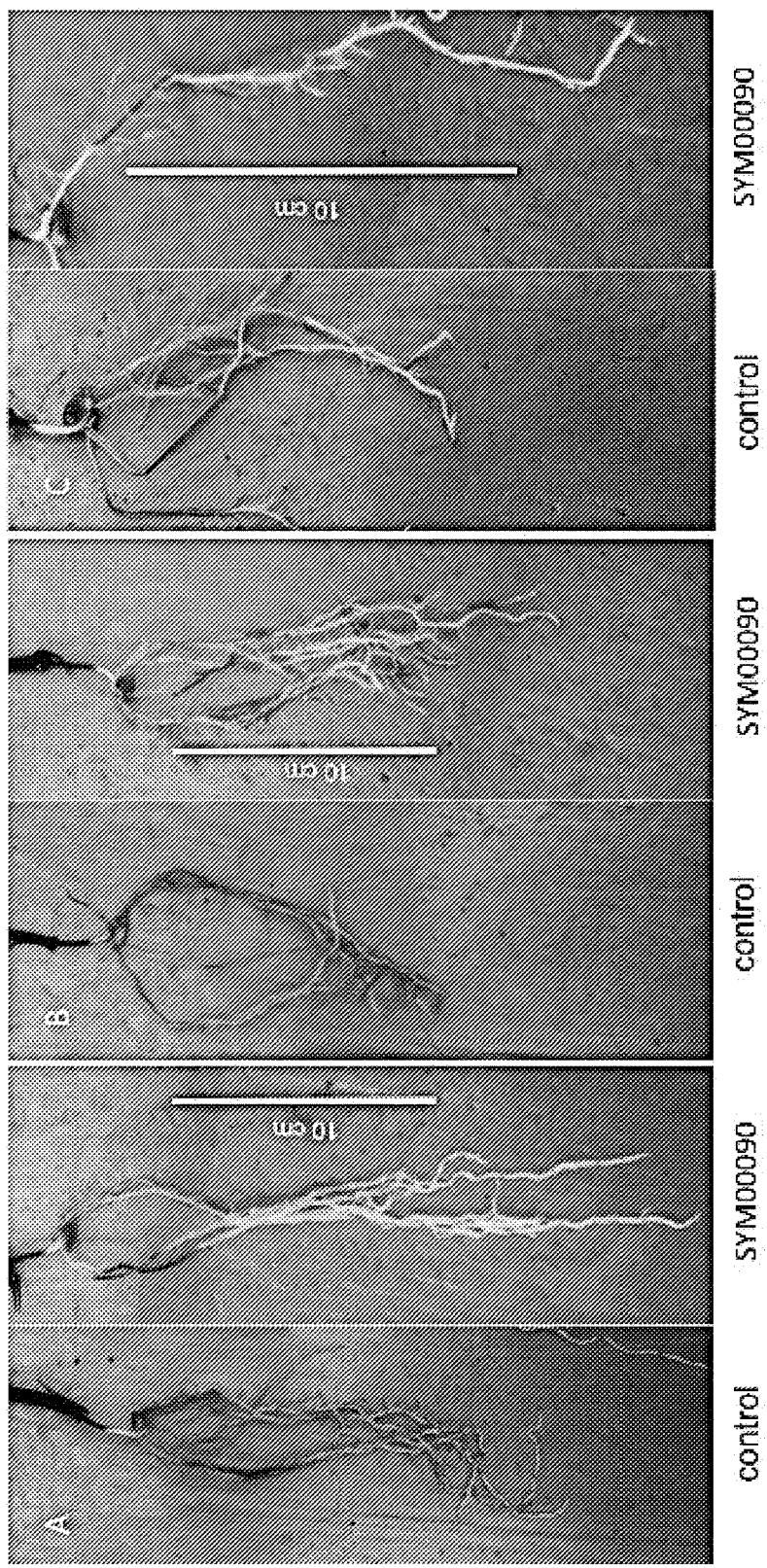
FIG. 7 contains representative photographs of roots of maize plants that germinated from non-inoculated (control) and inoculated seeds (SYM00090) and were exposed to A) normal, B) drought and C) cold conditions. For normal conditions, plants were kept on a growth chamber set up to 22° C., 60% relative humidity and 14 h light/10 dark cycle for 15 days after planting. For drought, water was removed from bottom container in double-decker Magenta box one week after planting and the sand was dried. Harvesting was done at 7 days after water was removed, when wilting symptoms appeared. For cold, the air temperature was set to 5° C., one week after planting and maintained for 7 days. The roots of the inoculated plant are not only larger but also show a larger amount of lateral roots and root-hairs.

Average measurements were compared against those for non-inoculated controls for each treatment. The results obtained with the magenta box assays are summarized in FIG. 7 and Table 13. Several bacterial endophytes provided significant plant growth improvement under normal and/or stressed conditions in maize. Notably, isolate SYM00090 provided growth improvement under normal, drought and cold conditions, mainly in the form of increased root length. Endophytes SYM00183, SYM00015, SYM00167 and SYM00168 also increased root length under drought conditions relative to non-inoculated controls. Almost all the endophytic bacteria tested provided increase gain in biomass under cold conditions. The magnitude of the difference in the conductance between normal conditions and drought conditions was significantly larger in the plants inoculated with SYM00231 relative to the non-inoculated controls, suggesting an improved water balance potentially related to closure of stomata.

TABLE 13

Summary of results of testing seed endophyte inoculated maize in plant growth tests on Magenta boxes.

| | | Maize (cv. Blue River 39A16 in magenta boxes Root length | | |
|---|---|---|---|---|
| SYM # | OTU | Normal | Drought | Cold |
| SYM00167 | 3 | 2 | 2 | — |
| SYM00183 | 10 | 3 | 3 | 2 |
| SYM00016b | 25 | — | — | — |
| SYM00015 | 29 | 3 | 3 | — |
| SYM00168 | 45 | 2 | 3 | 1 |
| SYM00231 | 46 | — | 2 | 1 |
| SYM00090 | 62 | 2 | 3 | 3 |

Legend:
"—" indicates no significant increase relative to non-inoculated control;
"1" = 0-5% increase relative to non-inoculated control;
"2" = 5-10% increase relative to non-inoculated control;
"3" = >10% increase relative to non-inoculated control.

Dose Response

Initial experiments described above were conducted to determine whether the microbe conferred beneficial traits to the colonized plant. We next sought to determine the amount of the microbe that is effective to confer any such benefit. In this example, selected microbial cultures were diluted to OD600 of 1.0, 0.1 and 0.01 (approximately $10^8$, $10^7$, $10^6$ CFU mL$^{-1}$ respectively) and applied onto wheat seeds (Briggs) using the water agar assay previously described.

SYM00011, SYM00033 and SYM00057B cultures were grown from a single colony in 5 mL of liquid R2A medium at room temperature on a shaker to stationary phase. The absorbance at 600 nm was measured and adjusted to an OD600 of 1.0 (~$10^8$ CFU mL$^{-1}$) in R2A media. Two additional dilutions at OD 0.1 and 0.01 (~$10^7$ and $10^6$ CFU mL$^{-1}$ respectively) were prepared by diluting the initial inoculum 10 and 100 times, again in R2A media.

Wheat seeds (Briggs) were sterilized overnight with chlorine gas and placed on water agar plates as described above. A 30 μL, drop of inoculum was placed on each seed, representing approximately $3.0 \times 10^6$, $3.0 \times 10^5$ and $3.0 \times 10^4$ CFU per seed for OD1, OD0.1 and OD0.01 inocula, respectively. For each treatment, 3 plates were prepared with 12 seeds each. Plates were sealed with surgical tape, randomized to avoid position effects and placed in a growth chamber set at 22° C., 60% relative humidity, in the dark for four days. After four days, a picture of each plate was taken and the root length of each seedling was measured using the imaging software ImageJ (NIH). The percentage difference between the treated plants and the mock-treated (R2A control) was then calculated.

Figure 8:
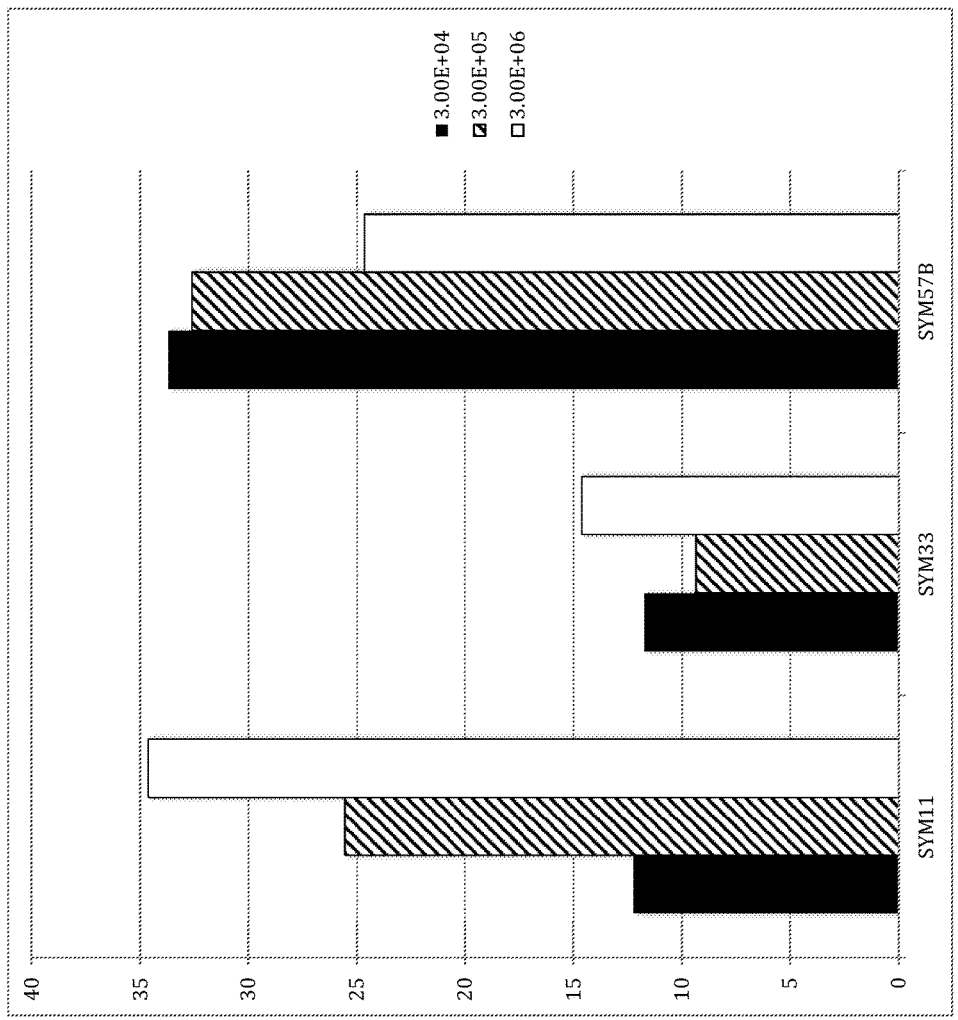
FIG. 8 is a graph depicting that seed endophytes show beneficial effects across a wide range of administered doses. Surface sterilized wheat seeds were inoculated with $3.0 \times 10^4$, $3.0 \times 10^5$, or $3.0 \times 10^6$ CFU seed$^{-1}$ of SYM00011, SYM00033, or SYM00057B. Shown are root lengths of each treatment, represented as a percentage increase over mock-inoculated controls.

All doses of the microbes at different concentration provided an increase in root length over the mock-treated controls as shown in FIG. 8. The optimal dose of microbes to confer a growth benefit to wheat varied for SYM00011, SYM00033 and SYM00057B. For SYM00011, we observed a positive correlation between the bacterial concentration of the inoculum and the growth benefits conferred to the plant, with ~$3.0 \times 10^6$ CFU seed$^{-1}$ (30 μL of OD600 of 1.0) being the most effective bacterial amount with a 35% increase in growth. For SYM00057B, plants treated with all three doses had similar root lengths, with the least concentrated inoculum ($3 \times 10^4$ CFU seed$^{-1}$) being the most effective amount, suggesting saturation at a lower concentration. Similarly, all three concentrations of SYM00033 provided similar benefits, also suggesting saturation at $3 \times 10^4$ CFU seed$^{-1}$.

Inoculation with Combinations of Endophytes

Microbial species colonizing habitats such as the seed endophytic microbes described herein are likely to interact with other microbes as well as with the host in exchanging carbon, energy and other metabolites. The electron flow and metabolism may involve multiple species for complete transfer, which would support the establishment of synergistic communities or assemblages. In certain cases, the beneficial effect of a single microbial inoculant from seeds can be magnified by the presence of a second synergistic endophyte favoring the establishment and persistence of the binary assemblage and their combined competence. To create assemblages or combinations of available endophytes in a collection, several approaches were followed, including:

1. Endophytes with similar or differing functionalities identified by in vitro testing. Plant growth promoting activities encompass multiple microbial mechanisms to affect plant physiology. These microbial attributes can be tested in vitro such as auxin production, production of glycosylhydrolases (such as xylanase, cellulase, pectinase, and chitinase, ACC deaminase activity), mineral phosphate solubilization, siderophore production, nitrogen fixation and antibiosis against plant pathogens among others. By combining endophytes with similar or differing functionalities, the plant benefits are improved as compared to the individual members.

2. Combinations based on endophyte origin or co-occurrence. Based on their isolation from the same seed two endophytes may form an efficient microbial assemblage that can be provided heterologously to novel hosts.

3. Endophytes with demonstrated germination vigor and/or stress resilience. Seedling germination assays allow testing plant early development, establishment of the seed endophytes in the plant and quantifiable beneficial effect in root length, weight or shoot length as compared to non-inoculated controls and the same isolates inoculated as singles.

4. Endophytes isolated from different hosts that may work synergistically. We isolated seed endophytes from multiple plant hosts. Members of this group are capable of showing beneficial effects on inoculated plants when combined as compared to their individual effects.

5. One member from 3 and one member of 4. Seed endophytes showing increased plant vigor and stress resilience are combined with novel seed endophytes and their synergistic interaction amplifies the individual responses.

These combinations were tested with the collection of seed endophytes representing the 44 OTUs in vigor and stress resilience assays in maize (Table 14a), wheat (Table 14b), barley (Table 14c) and soy (Table 14d-f).

Table 14.

Assessing the effects of creating synthetic combinations of multiple seed endophytes with seeds.

TABLE 14(a)

Maize seedling vigor assessment using filter paper assay.

| | | | Maize (cv. Blue River 40R73) on filter paper | | | | | | | | | |
|---|---|---|---|---|---|---|---|---|---|---|---|---|
| | | | Root Length | | | | | Weight | | | | |
| SYM #1 | SYM #2 | Ap | N | H | S | H/S | D | N | H | S | H/S | D |
| SYM00002 | SYM00046 | 1 | — | — | — | — | 3 | — | 1 | — | — | 1 |
| SYM00002 | SYM00050 | 1 | — | 1 | — | 2 | — | 2 | — | — | — | — |
| SYM00011 | SYM00046 | 1 | — | — | — | — | 1 | — | 2 | — | — | 1 |
| SYM00011 | SYM00050 | 1 | — | — | 2 | 2 | 3 | — | 3 | — | — | 2 |
| SYM00017c | SYM00046 | 1 | — | — | — | — | 3 | — | — | — | — | 1 |
| SYM00017c | SYM00050 | 1 | 1 | — | 1 | 1 | 2 | — | — | 1 | — | 1 |
| SYM00033 | SYM00046 | 1 | — | — | — | — | 3 | 3 | — | 2 | — | 1 |
| SYM00033 | SYM00050 | 1 | — | — | — | 1 | 1 | — | 1 | 1 | — | 2 |
| SYM00049 | SYM00046 | 1 | — | — | — | — | — | — | — | — | — | 2 |
| SYM00049 | SYM00050 | 1 | — | — | 1 | 3 | — | — | — | — | — | — |
| SYM00172 | SYM00046 | 1 | — | — | 2 | — | — | — | — | — | — | — |
| SYM00172 | SYM00050 | 1 | — | 3 | 1 | 3 | — | — | 1 | — | — | — |
| SYM00231 | SYM00046 | 1 | — | — | — | — | 3 | — | — | 1 | — | 1 |
| SYM00231 | SYM00050 | 1 | — | 2 | 1 | 2 | — | — | 2 | — | — | — |
| SYM00017c | SYM00090 | 4 | — | 3 | 1 | 3 | — | 1 | — | — | — | 2 |
| SYM00017c | SYM00231 | 4 | 1 | 3 | 1 | 3 | 1 | 1 | 1 | — | — | — |
| SYM00231 | SYM00090 | 4 | — | — | 1 | 3 | — | 3 | 1 | — | — | — |
| SYM00011 | SYM00016b | 5 | — | 2 | 3 | 3 | 1 | 2 | — | — | — | 1 |
| SYM00011 | SYM00090 | 5 | 1 | — | 3 | 3 | 3 | 1 | 1 | — | — | 1 |
| SYM00011 | SYM00102 | 5 | — | 3 | 3 | 3 | 1 | 2 | 1 | — | — | 2 |
| SYM00011 | SYM00188 | 5 | — | 3 | 1 | 3 | 1 | — | — | — | — | 2 |
| SYM00090 | SYM00102 | 5 | 1 | 3 | 3 | 3 | 3 | 3 | 1 | — | — | 3 |
| SYM00102 | SYM00188 | 5 | 1 | 2 | 1 | 3 | — | — | 1 | — | — | — |
| SYM00057b | SYM00090 | 6 | 1 | 3 | — | 3 | 3 | 2 | — | — | — | 1 |
| SYM00057b | SYM00231 | 6 | 2 | 2 | 1 | 3 | 3 | 2 | — | 1 | — | — |
| SYM00102 | SYM00231 | 6 | — | — | 1 | 3 | — | 1 | — | — | — | — |
| SYM00589 | SYM00090 | 6 | 1 | — | — | 3 | — | — | — | — | — | — |
| SYM00589 | SYM00231 | 6 | 3 | 3 | — | 3 | 1 | 1 | — | — | — | — |
| SYM00596 | SYM00090 | 6 | 2 | 3 | 1 | 3 | 3 | 3 | — | 1 | — | — |
| SYM00596 | SYM00231 | 6 | 1 | — | 2 | 3 | 3 | 2 | 3 | — | — | 1 |

Legend: "—" indicates no significant increase relative to non-inoculated control; "1" = 0-5% increase relative to non-inoculated control; "2" = 5-10% increase relative to non-inoculated control; "3" = >10% increase relative to non-inoculated control.
Conditions: N = normal, H = heat, S = salt, H/S = heat and salt, D = drought.
Ap: Approach = conceptual paradigm used for selecting endophyte combinations (see text above)

TABLE 14(b)

Wheat seedling vigor assessment using filter paper assay.

| | | | Wheat (cv. Briggs) on filter paper | | | | | | | |
|---|---|---|---|---|---|---|---|---|---|---|
| | | | Root Length | | | Shoot Length | | | Weight | |
| SYM #1 | SYM #2 | Ap | N | H | S | N | S | D | N | S | D |
| SYM00002 | SYM00046 | 1 | 3 | | | | | | — | — | |
| SYM00002 | SYM00050 | 1 | 3 | | | | | | — | — | |
| SYM00011 | SYM00046 | 1 | 3 | | | | | 1 | — | — | |
| SYM00011 | SYM00050 | 1 | — | | | | | | — | — | |
| SYM00017c | SYM00046 | 1 | 2 | | | | | — | | | 1 |
| SYM00017c | SYM00050 | 1 | — | | | | | — | | | 2 |

TABLE 14(b)-continued

Wheat seedling vigor assessment using filter paper assay.

| | | | Wheat (cv. Briggs) on filter paper | | | | | | | | |
|---|---|---|---|---|---|---|---|---|---|---|---|
| | | | Root Length | | | Shoot Length | | | Weight | | |
| SYM #1 | SYM #2 | Ap | N | H | S | N | S | D | N | S | D |
| SYM00033 | SYM00046 | 1 | 3 | | | | — | | | — | |
| SYM00033 | SYM00050 | 1 | — | | | | — | | | | 1 |
| SYM00049 | SYM00046 | 1 | 1 | | | | — | | | — | |
| SYM00049 | SYM00050 | 1 | 3 | | | | — | | | — | |
| SYM00172 | SYM00046 | 1 | — | | | | 1 | | | — | |
| SYM00172 | SYM00050 | 1 | — | | | | — | | | | 1 |
| SYM00231 | SYM00046 | 1 | 1 | | | | — | | | — | |
| SYM00231 | SYM00050 | 1 | 1 | | | | — | | | | 1 |
| SYM00063b | SYM00050 | 2 | 1 | — | — | 2 | 3 | 3 | 3 | 3 | 3 |
| SYM00063b | SYM00192 | 2 | 3 | — | — | 2 | — | — | 3 | 1 | — |
| SYM00175 | SYM00050 | 2 | — | — | — | — | 3 | 3 | — | 2 | — |
| SYM00002 | SYM00017c | 3 | 3 | — | 1 | 1 | 3 | 3 | 1 | 3 | 3 |
| SYM00049 | SYM00016b | 3 | 3 | — | — | 3 | — | 3 | — | 2 | 3 |
| SYM00057b | SYM00016b | 3 | 1 | 2 | — | 2 | 3 | 3 | 3 | 3 | 1 |
| SYM00057b | SYM00192 | 3 | 2 | — | 1 | — | 3 | 3 | 1 | 3 | — |
| SYM00167 | SYM00017c | 3 | — | — | — | 2 | 3 | 3 | 3 | 3 | 1 |
| SYM00188 | SYM00016b | 3 | — | — | — | 3 | — | 3 | 1 | 1 | — |
| SYM00017c | SYM00090 | 4 | 3 | | | | | | | | |
| SYM00017c | SYM00231 | 4 | 3 | | | | | | | | |
| SYM00231 | SYM00090 | 4 | 3 | | | | | | | | |
| SYM00965 | SYM00017c | 4 | 3 | | | | | | | | |
| SYM00965 | SYM00090 | 4 | 2 | | | | | | | | |
| SYM00965 | SYM00231 | 4 | 3 | | | | | | | | |
| SYM00011 | SYM00016b | 5 | 2 | | | | | | | | |
| SYM00011 | SYM00090 | 5 | 3 | | | | | | | | |
| SYM00011 | SYM00102 | 5 | 3 | | | | | | | | |
| SYM00011 | SYM00188 | 5 | 3 | | | | | | | | |
| SYM00016b | SYM00090 | 5 | 3 | | | | | | | | |
| SYM00016b | SYM00102 | 5 | 3 | | | | | | | | |
| SYM00016b | SYM00188 | 5 | 3 | | | | | | | | |
| SYM00090 | SYM00102 | 5 | 2 | | | | | | | | |
| SYM00090 | SYM00188 | 5 | 2 | | | | | | | | |
| SYM00102 | SYM00188 | 5 | 3 | | | | | | | | |
| SYM00002 | SYM00090 | 6 | 3 | | | | | | | | |
| SYM00002 | SYM00231 | 6 | 1 | | | | | | | | |
| SYM00057b | SYM00090 | 6 | 3 | | | | | | | | |
| SYM00057b | SYM00231 | 6 | 3 | | | | | | | | |
| SYM00102 | SYM00231 | 6 | 1 | | | | | | | | |
| SYM00218 | SYM00090 | 6 | 3 | | | | | | | | |
| SYM00218 | SYM00231 | 6 | 2 | | | | | | | | |
| SYM00589 | SYM00090 | 6 | — | | | | | | | | |
| SYM00589 | SYM00231 | 6 | 1 | | | | | | | | |
| SYM00596 | SYM00090 | 6 | 1 | | | | | | | | |
| SYM00596 | SYM00231 | 6 | 3 | | | | | | | | |

Legend: "—" indicates no significant increase relative to non-inoculated control; "1" = 0-5% increase relative to non-inoculated control; "2" = 5-10% increase relative to non-inoculated control; "3" = >10% increase relative to non-inoculated control.
Conditions: N = normal, H = heat, S = salt, H/S = heat and salt, D = drought.
Ap: Approach = conceptual paradigm used for selecting endophyte combinations (see text above)

TABLE 14(c)

Barley seedling vigor assessment using filter paper assay.

| | | | (cv. Robust) | | | | | | (cv. Conlon) | | |
|---|---|---|---|---|---|---|---|---|---|---|---|
| Barley on filter paper | | | Root length | | | Germination | | | Germination | | |
| SYM #1 | SYM #2 | Ap | N | S | D | N | S | D | N | S | D |
| SYM00057b | SYM00016b | 3 | — | — | — | — | — | 2 | — | — | — |
| SYM00057b | SYM00192 | 3 | — | 3 | — | 1 | — | 1 | — | — | 2 |
| SYM00011 | SYM00090 | 5 | — | — | 1 | — | — | — | 3 | — | 3 |
| SYM00090 | SYM00102 | 5 | 1 | — | — | — | — | 1 | — | 3 | — |
| SYM00057b | SYM00090 | 6 | — | 1 | — | 1 | — | 2 | — | 2 | — |
| SYM00057b | SYM00231 | 6 | — | — | 1 | — | — | — | — | 3 | 3 |

TABLE 14(c)-continued

Barley seedling vigor assessment using filter paper assay.

| Barley on filter paper | | | (cv. Robust) | | | | | (cv. Conlon) | |
|---|---|---|---|---|---|---|---|---|---|
| | | | Root length | | | Germination | | Germination | |
| SYM #1 | SYM #2 | Ap | N | S | D | N | S | D | N | S | D |
| SYM00596 | SYM00090 | 6 | — | — | — | 2 | — | — | 3 | 3 | 2 |
| SYM00596 | SYM00231 | 6 | — | — | — | — | 1 | 2 | — | — | 3 |

Legend: "—" indicates no significant increase relative to non-inoculated control; "1" = 0-5% increase relative to non-inoculated control; "2" = 5-10% increase relative to non-inoculated control; "3" = >10% increase relative to non-inoculated control.
Conditions: N = normal, H = heat, S = salt, H/S = heat and salt, D = drought.
Ap: Approach = conceptual paradigm used for selecting endophyte combinations (see text above).

TABLE 14(d)

Soy seedling vigor assessment using water agar assay inoculated with a combination of two bacterial endophytes.

| Soy (cv. Butterbean) on water agar | | | 1.3% agar | 0.6% agar | | | |
|---|---|---|---|---|---|---|---|
| SYM #1 | SYM #2 | Ap | N | N | S | H | D |
| SYM00002 | SYM00046 | 1 | | | 2 | 3 | — |
| SYM00002 | SYM00050 | 1 | | | 3 | — | |
| SYM00011 | SYM00046 | 1 | | 3 | 1 | 1 | |
| SYM00011 | SYM00050 | 1 | | — | 3 | | |
| SYM00017c | SYM00046 | 1 | | — | — | 2 | |
| SYM00017c | SYM00050 | 1 | | — | 1 | — | |
| SYM00033 | SYM00046 | 1 | | — | 1 | 2 | |
| SYM00049 | SYM00046 | 1 | | 3 | 3 | 3 | |
| SYM00049 | SYM00050 | 1 | | 2 | — | 3 | |
| SYM00172 | SYM00046 | 1 | | 3 | 3 | 1 | |
| SYM00231 | SYM00046 | 1 | | — | 1 | — | |
| SYM00002 | SYM00017c | 3 | | 3 | 3 | 1 | |
| SYM00049 | SYM00016b | 3 | | 3 | 3 | | |
| SYM00057b | SYM00016b | 3 | 3 | | | | |
| SYM00057b | SYM00192 | 3 | 3 | | | | |
| SYM00167 | SYM00017c | 3 | | 3 | 3 | 3 | |
| SYM00060 | SYM00975 | 3 | | 2 | 2 | 3 | |
| SYM00176 | SYM00012 | 3 | | 3 | 3 | 2 | |
| SYM00176 | SYM00057B | 3 | | 3 | 2 | 1 | |
| SYM00176 | SYM00940 | 3 | | 1 | 3 | — | |
| SYM00176 | SYM00975 | 3 | | 3 | 3 | 3 | |
| SYM00218 | SYM00508 | 3 | | 2 | 3 | | 1 |
| SYM00218 | SYM00940 | 3 | | — | — | | 2 |
| SYM00218 | SYM00991 | 3 | | — | 2 | — | |
| SYM00508 | SYM00940 | 3 | | 3 | 2 | | 2 |
| SYM00508 | SYM00991 | 3 | | 2 | 3 | | 3 |
| SYM00940 | SYM00057B | 3 | | 1 | 2 | 1 | |
| SYM00940 | SYM00975 | 3 | | — | 2 | | 2 |
| SYM00940 | SYM00991 | 3 | | 2 | 3 | | 1 |
| SYM00017c | SYM00090 | 4 | | 2 | 3 | 3 | |
| SYM00017c | SYM00231 | 4 | | 1 | 2 | 3 | |
| SYM00231 | SYM00090 | 4 | | 1 | 3 | — | |
| SYM00011 | SYM00016b | 5 | | 3 | 2 | 3 | |
| SYM00011 | SYM00090 | 5 | | — | | | |
| SYM00011 | SYM00102 | 5 | | 3 | | 3 | |
| SYM00011 | SYM00188 | 5 | | 2 | | 3 | |
| SYM00016b | SYM00090 | 5 | | — | — | 3 | |
| SYM00016b | SYM00102 | 5 | | 3 | 2 | 3 | |
| SYM00016b | SYM00188 | 5 | | 1 | | 3 | |
| SYM00090 | SYM00102 | 5 | 1 | | | | |
| SYM00090 | SYM00188 | 5 | | — | | 3 | |
| SYM00102 | SYM00188 | 5 | | — | | 3 | |
| SYM00002 | SYM00090 | 6 | | 3 | — | 2 | |
| SYM00002 | SYM00231 | 6 | | — | 1 | — | |
| SYM00057b | SYM00090 | 6 | 3 | | | | |
| SYM00057b | SYM00231 | 6 | 3 | | | | |
| SYM00102 | SYM00231 | 6 | | — | | | |
| SYM00596 | SYM00090 | 6 | | 2 | 3 | 3 | — |
| SYM00596 | SYM00231 | 6 | 3 | | | | |

Legend: "—" indicates no significant increase in radicle length relative to non-inoculated control; "1" = 0-5% increase relative to non-inoculated control; "2" = 5-10% increase relative to non-inoculated control; "3" = >10% increase relative to non-inoculated control.
Conditions; N = normal, S = salt, H = heat, D = drought.
Ap = conceptual paradigm used for selecting endophyte combinations (see text above).

TABLE 14(e)

Soy seedling vigor assessment using water agar assay inoculated with a combination of three bacterial endophytes.

| | | | Soy (cv Butterbean) on water agar | | | |
|---|---|---|---|---|---|---|
| SYM #1 | SYM #2 | SYM #3 | N | S | H | D |
| SYM00002 | SYM00940 | SYM00057B | — | 1 | 1 | |
| SYM00011 | SYM00016B | SYM00017C | 3 | — | — | |
| SYM00011 | SYM00016B | SYM00102 | 2 | 1 | 1 | |
| SYM00011 | SYM00016B | SYM00188 | — | — | — | |
| SYM00011 | SYM00016B | SYM00965 | 3 | 1 | 3 | |
| SYM00011 | SYM00017C | SYM00102 | 2 | — | — | |
| SYM00011 | SYM00017C | SYM00188 | — | — | — | |
| SYM00011 | SYM00017C | SYM00965 | 3 | 1 | — | |
| SYM00011 | SYM00090 | SYM00016B | 3 | 3 | — | |
| SYM00011 | SYM00090 | SYM00017C | 3 | — | 3 | |
| SYM00011 | SYM00090 | SYM00102 | 2 | 1 | — | |
| SYM00011 | SYM00090 | SYM00188 | 3 | 3 | 2 | |
| SYM00011 | SYM00090 | SYM00965 | 2 | 1 | — | |
| SYM00057B | SYM00017C | SYM00002 | 2 | 2 | 1 | |
| SYM00057B | SYM00231 | SYM00016b | — | — | — | |
| SYM00090 | SYM00016B | SYM00017C | 3 | 2 | 2 | |
| SYM00090 | SYM00016B | SYM00102 | 3 | — | — | |
| SYM00090 | SYM00016B | SYM00188 | 3 | — | 3 | |
| SYM00090 | SYM00016B | SYM00965 | 3 | 3 | — | |
| SYM00090 | SYM00188 | SYM00965 | 3 | 2 | — | |
| SYM00188 | SYM00011 | SYM00965 | 3 | — | — | |
| SYM00188 | SYM00016B | SYM00965 | 3 | 2 | 2 | |
| SYM00188 | SYM00102 | SYM00965 | — | — | 1 | |
| SYM00218 | SYM00107 | SYM00002 | 3 | — | — | |
| SYM00218 | SYM00107 | SYM00046 | 2 | — | 3 | |
| SYM00218 | SYM00107 | SYM00057B | 3 | — | 2 | |
| SYM00218 | SYM00107 | SYM00940 | 3 | — | 3 | |
| SYM00218 | SYM00231 | SYM00002 | — | — | — | |
| SYM00218 | SYM00231 | SYM00046 | 2 | — | 3 | |
| SYM00218 | SYM00231 | SYM00057b | 3 | — | — | |
| SYM00218 | SYM00231 | SYM00107 | — | — | 3 | |
| SYM00218 | SYM00231 | SYM00290 | — | — | 1 | |
| SYM00218 | SYM00231 | SYM00498 | 3 | — | — | |

TABLE 14(e)-continued

Soy seedling vigor assessment using water agar assay inoculated with a combination of three bacterial endophytes.

| | | | Soy (cv Butterbean) on water agar | | | |
|---|---|---|---|---|---|---|
| SYM #1 | SYM #2 | SYM #3 | N | S | H | D |
| SYM00218 | SYM00231 | SYM00508 | 1 | — | — | |
| SYM00218 | SYM00231 | SYM00940 | — | — | — | |
| SYM00218 | SYM00508 | SYM00290 | — | 2 | — | |
| SYM00218 | SYM00508 | SYM00940 | 1 | 1 | — | |
| SYM00218 | SYM00508 | SYM00975 | 1 | — | | 2 |
| SYM00218 | SYM00508 | SYM00991 | 3 | 2 | — | |
| SYM00231 | SYM00107 | SYM00290 | 2 | — | — | |
| SYM00231 | SYM00107 | SYM00498 | 3 | — | 1 | |
| SYM00231 | SYM00107 | SYM00508 | 2 | — | — | |
| SYM00508 | SYM00940 | SYM00991 | 3 | 2 | | 1 |
| SYM00940 | SYM00046 | SYM00596 | 3 | 3 | 3 | |
| SYM00940 | SYM00057B | SYM00046 | 2 | — | — | |
| SYM00991 | SYM00940 | SYM00218 | 3 | 2 | | 3 |
| SYM00991 | SYM00940 | SYM00975 | 1 | 3 | | 2 |

Legend: "—" indicates no significant increase in radicle length relative to non-inoculated control; "1" = 0-5% increase relative to non-inoculated control; "2" = 5-10% increase relative to non-inoculated control; "3" = >10% increase relative to non-inoculated control. Conditions; N = normal, S = salt, H = heat, D = drought.

TABLE 14(f)

Selected comparison of vigor assessment in soy under normal condition (water agar) between bacterial endophyte trios, binaries and single isolate treatments.
Soy seedling assay (cv. Butterbean on water agar)

| SYM #1 | SYM #2 | SYM #3 | Normal |
|---|---|---|---|
| SYM00218 | SYM00508 | SYM00991 | 3 |
| SYM0099 | SYM00940 | SYM00218 | 3 |
| SYM00218 | SYM00940 | | 0 |
| SYM00940 | SYM00991 | | 2 |
| SYM00508 | SYM00991 | | 2 |
| SYM00218 | SYM00508 | | 2 |
| SYM00218 | SYM00991 | | 0 |
| SYM00218 | | | 1 |
| SYM00508 | | | 0 |
| SYM00940 | | | 0 |
| SYM00991 | | | 0 |

Legend:
"—" indicates no significant increase in radicle length relative to non-inoculated control;
"1" = 0-5% increase relative to non-inoculated control;
"2" = 5-10% increase relative to non-inoculated control;
"3" = >10% increase relative to non-inoculated control.

A total of eight binary bacterial combinations were tested on two barley cultivars (Robust and Conlon); of these, 62% root growth in the Robust cultivar under at least one condition tested. 37% of the combinations were observed with increased root length in similar conditions (Table 14c). Notably, combinations containing SYM00057B show a strong stimulation of root growth despite no observable benefit when the constituent isolates were tested individually. For instance, neither SYM00057B nor SYM00016B provoke any increase in root growth, however the combination of these two endophytes increased root length more than 10% when compared to the control (Table 14c). SYM00090 alone also provides no root growth stimulation in contrast to its combination with SYM00057B which increases root length 5-10% over the control (Table 14c). Germination rates were also improved at a relatively higher rate in combination treatments over the control when compared to individual treatments. For instance, 75% of combinations increased germination in Robust under at least one test condition while nearly 90% of combinations increased Conlon germination under one or more test condition (Table 14c). Of note, approximately 60% of pairs positively affect Robust germination under drought stress compared to only 12% of individual endophytes (Table 11a, Table 14c).

Figure 9:
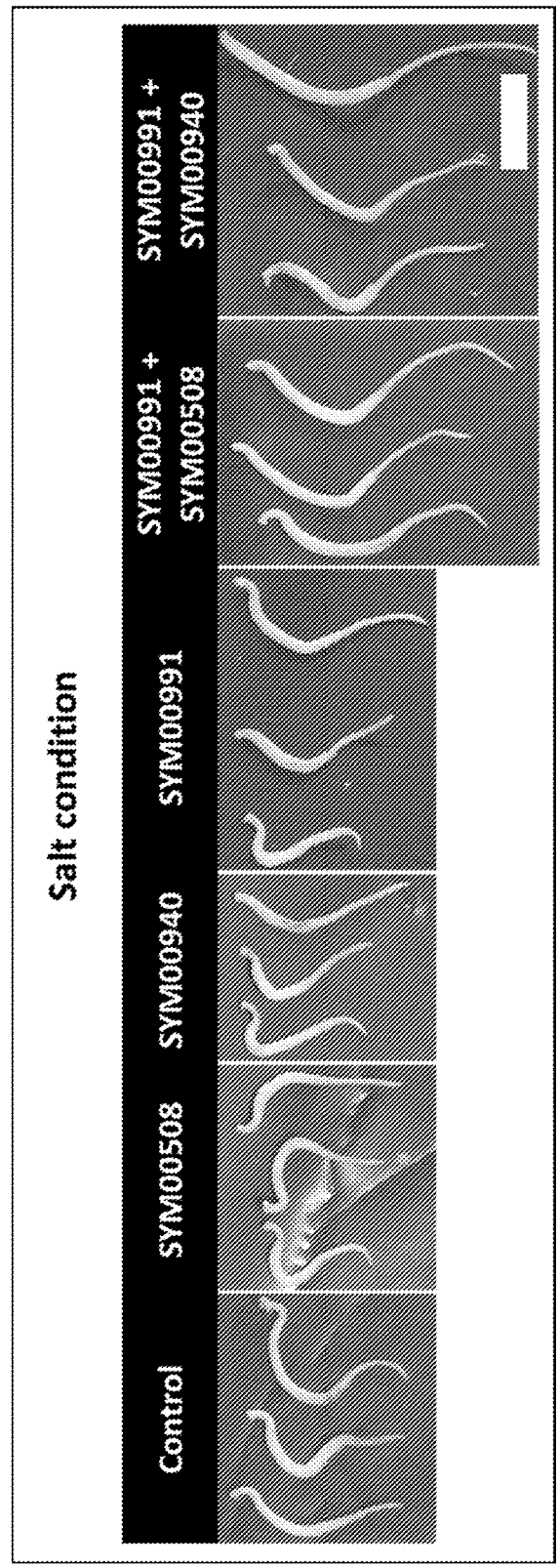
FIG. 9 contains representative photographs depicting roots of 5-day old soy seedlings (cultivar Butterbean) grown on water agar under salt stress (50 mM NaCl) whose seeds were inoculated with a single seed endophyte (SYM00508, SYM00940, or SYM00991) or a combination of seed endophytes (SYM00508+SYM00991, or SYM00940+SYM00991). Scale bar=1 cm. There is a synergistic increase in root length of soy plants inoculated with combinations of seed-borne endophytes.

A total of 63 binary combinations of endophytes were tested for vigor and stress resilience against heat, salt, heat-salt or drought and scored for improved vigor and/or stress resilience in wheat, maize or soy. Visible increase in shoot length for wheat was observed when the binaries were paired based on their seed origin for isolation and also based on the selection from the vigor and stress resilience assays indicating that additive effects can be observed as compared to the effect from individual stresses. In soy, the combination of SYM00011 and SYM00016B under normal condition greatly improved vigor while SYM00011 and SYM00016B did not individually, demonstrating the synergistic effect obtained by combining those two endophytes. Other cases of synergy in soy were obtained by combining SYM00991 with either SYM00940 or SYM00508 under salt condition (FIG. 9). Another interesting response was observed for maize when inoculated with the binary formed by SYM00090 related to *Chryseobacterium*, a representative member of OTU 62 and SYM00231 related to *Sphingobium* and a representative member of OTU 46 provided protection against heat-salt stress in maize and vigor in wheat as measured for root length in both assays.

Figure 10:
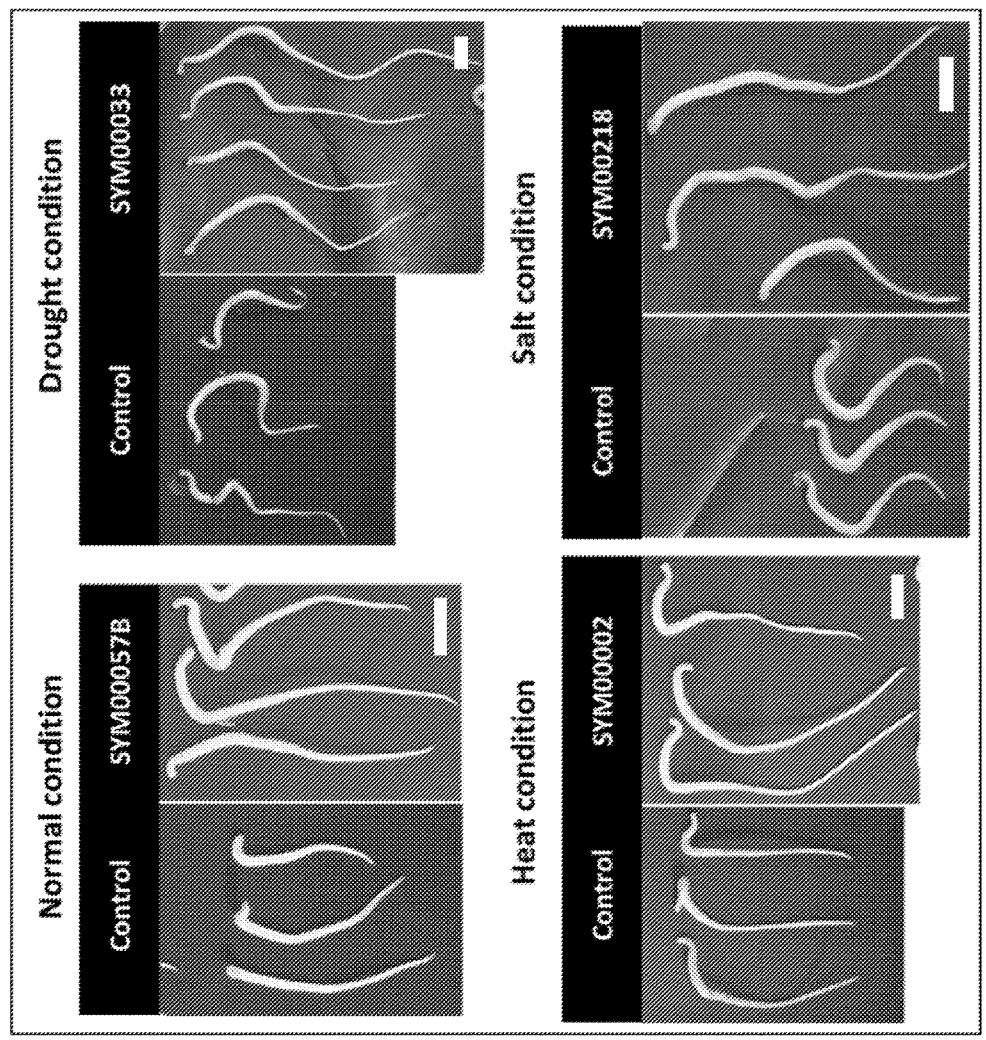
FIG. 10 contains representative photographs depicting roots of 5-day old soy seedlings (cultivar Butterbean) whose seeds were inoculated with the endophyte SYM00057B and grown under normal conditions (top left), SYM00033 and grown under drought conditions (PEG) (top right), SYM00002 and grown under heat stress (bottom left), and SYM00218 and grown under salt stress (50 mM NaCl). Scale bar=1 cm. Root length of soy plants increased when inoculated with seed endophytes.

Other endophyte combinations were based on the production of auxin for isolates SYM00011, SYM00017c, SYM00033, SYM00049, SYM00002, SYM00062b, SYM00172 and SYM00231 paired with the ability to produce cellulolytic and pectinolytic enzymes in isolate SYM00050. These endophyte combinations showed an enhancement in plant response to heat and salt stress as compared to the same set of auxin producing isolates paired with SYM00046 where drought stress was enhanced compared to the previous set. The drought resilience enhancement seen in seedling phenotypes in wheat as compared to controls is the result of the plant response to inoculation and molecular mechanisms behind the complex interaction between endophytic bacteria and their crop plant hosts. One example is the up-regulation of the protein pectin esterase in inoculated plants and the established involvement of that protein in plant drought protection. In addition, inoculation with a combination of 4 endophytes SYM00017b, SYM00049, SYM00057b and SYM00188 in maize dramatically increased the production of the plant hormone abscisic acid as compared to inoculation with individual isolates indicating an enhanced beneficial effect at the molecular level with inoculation of plant with assemblages of endophytes compared to individual endophytes. In addition to the combination of two endophytes (binaries) (Table 14d), 47 combinations of three endophytes (trios) were tested in soy under normal and stress conditions (Table 14e). Inoculation with a combination of three endophytes provided enhanced benefits compared to inoculation with binaries and single isolate treatments in a number of cases. The positive plant response to inoculation with two trio combinations of endophytes, SYM00218+SYM00508+SYM00991 and SYM00991+SYM00940+SYM00218 along with their respective binaries and singles shows the superior performance of trios over binaries and single treatments which failed to provide full protection from abiotic stress (Table 14f and FIG. 10).

In one embodiment, synthetic combinations of soybean plants with a plurality of two bacterial endophyte entities confers strong resistance to a range of abiotic stresses such as heat, drought and salinity as provided herein. Notably, the bacterial endophytes individually confer variable and low level resistance to one or multiple abiotic stresses such as heat, drought, or salinity (e.g. SYM00176, SYM00975), while inoculation with a combination of two bacterial endophyte entities (e.g. SYM00176+SYM00975) was demonstrated to provide strong protection from a broad range of abiotic stresses.

In one embodiment, synthetic combinations of soybean plants with a plurality of two bacterial endophyte entities confers strong resistance to a range of abiotic stresses such as heat, drought and salinity as provided herein. Notably, the bacterial endophytes individually confer strong resistance to multiple abiotic stresses such as heat, drought, or salinity (e.g. SYM00167, SYM0017C), while inoculation with a combination of two bacterial endophyte entities (e.g. SYM00167+SYM00917C) was demonstrated to provide strong protection from a broad range of abiotic stresses.

In one embodiment, synthetic combinations of soybean plants with a plurality of three bacterial endophyte entities synergistically confer stress resistance, including embodiments wherein each bacterial endophyte is not recognized as capable of conferring resistance to one or multiple abiotic stresses such as heat, drought, or salinity when applied individually (e.g., SYM00218, SYM00508, SYM0940, SYM00991), are capable of synergistically conferring resistance to a range of abiotic stresses when applied in combinations of two entities (e.g., SYM00218+SYM00991, SYM00218+SYM00508, SYM00508+SYM0091, SYM00218+SYM00940) or in combinations of three entities (e.g., SYM0099+SYM00940+SYM00218, SYM00218+SYM00508+SYM00991).

In one embodiment, synthetic combinations of barley plants with a plurality of two bacterial endophyte entities synergistically confer stress resistance to multiple cultivars, including embodiments wherein each bacterial endophyte is not recognized as capable of conferring resistance to multiple abiotic stresses such as heat, drought, or salinity when applied individually (e.g., SYM00057B, SYM00192), are capable of synergistically conferring resistance to a range of abiotic stresses when applied in combinations of two entities (e.g., SYM00057B+SYM00192).

In one embodiment, synthetic combinations of barley plants with a plurality of two bacterial endophyte entities synergistically confer stress resistance to multiple cultivars, including embodiments wherein each bacterial endophyte is not recognized as capable of conferring resistance to multiple abiotic stresses such as heat, drought, or salinity when applied individually (e.g., SYM00057B, SYM0016B), are capable of synergistically conferring resistance to a range of abiotic stresses when applied in combinations of two entities (e.g., SYM00057B+SYM00016B).

Example 7—Proteomic Analysis of Inoculated Plants

As shown in some of the earlier examples, endophytic microbes described herein are capable of conferring significant beneficial traits on the inoculated agricultural plant. In order to explore the pathways augmented or otherwise modified by the endophyte, we performed proteomic analysis on extracts of wheat, maize and soy plants grown on water agar. Sterilized wheat, maize and soy seeds were either mock-inoculated with R2A medium (formulation control), or inoculated with selected endophytes using conditions previously described. The seeds were subjected to the growth parameters as summarized below (Table 15).

TABLE 15

Samples used for proteomic measurements.

| Sample # | Crop | Test | Condition |
|---|---|---|---|
| 1 | Wheat (Briggs) | Formulation control | Normal |
| 2 | Wheat (Briggs) | SYM00218 | Normal |
| 3 | Wheat (Briggs) | Formulation control | Heat |
| 4 | Wheat (Briggs) | SYM00011 | Heat |
| 5 | Wheat (Briggs) | SYM00016 | Heat |
| 6 | Wheat (Briggs) | SYM00057B | Heat |
| 7 | Maize (40R73) | Formulation control | Normal |
| 8 | Maize (40R73) | SYM00057B | Normal |
| 9 | Soy (Butterbean) | Formulation control | Normal |
| 10 | Soy (Butterbean) | SYM00057B | Normal |
| 11 | Soy (Butterbean) | SYM00498 | Normal |
| 12 | Soy (Butterbean) | SYM00596 | Normal |
| 13 | Soy (Butterbean) | Formulation control | Normal |
| 14 | Soy (Butterbean) | SYM00002 | Normal |
| 15 | Soy (Butterbean) | SYM00046 | Normal |
| 16 | Soy (Butterbean) | SYM00052 | Normal |
| 17 | Soy (Butterbean) | Formulation control | Normal |
| 18 | Soy (Butterbean) | SYM00218 | Normal |
| 19 | Soy (Butterbean) | SYM00508 | Normal |
| 20 | Soy (Butterbean) | SYM00940 | Normal |

Sample Collection

Maize and wheat: After 4 days of growth, 12 whole seedlings (including roots, seeds and hypocotyls) per treatment were collected in a 50 mL falcon tube using sterile forceps and immediately snap-frozen in liquid nitrogen to minimize protein degradation and proteomic changes during sample collection (such as wound responses from using the forceps). The frozen samples were then homogenized using a pestle and mortar previously cooled in liquid nitrogen and transferred to a 15 mL falcon tube on dry ice. The homogenized samples were stored at −80° C. until further processing.

Soy: After 5 days of growth, the roots of 27 seedlings per treatment were collected in a 50 mL falcon tube using flamed forceps and immediately snap-frozen in liquid nitrogen to minimize protein degradation and proteomic changes during sample collection (such as wound responses from using the forceps). The frozen samples were then homogenized using a pestle and mortar previously cooled in liquid nitrogen and transferred to a 15 mL falcon tube on dry ice. The homogenized samples were stored at −80° C. until further processing.

Sample Preparation 1 mL of 5% SDS 1 mM DTT was added to 1 mL of homogenized tissue and the samples were boiled for 5 m. The samples were cooled on ice and 2 mL of 8M urea solution was added. The samples were spun for 20 m at 14,000 rpm and the soluble phase recovered. A 25% volume of 100% TCA solution was added to the soluble phase, left on ice for 20 m and centrifuged for 10 m at 14,000 rpm. The protein pellet was washed twice with ice-cold acetone and solubilized in 125 μL 0.2M NaOH and neutralized with 125 μL of 1M Tris-Cl pH 8.0. Protein solutions were diluted in THE (50 mM Tris-Cl pH8.0, 100 mM NaCl, 1 mM EDTA) buffer. RapiGest SF reagent (Waters Corp., Milford, Mass.) was added to the mix to a final concentration of 0.1% and samples were boiled for 5 min. TCEP (Tris (2-carboxyethyl) phosphine) was added to 1 mM (final concentration) and the samples were incubated at 37° C. for 30 min. Subsequently, the samples were carboxymethylated with 0.5 mg ml$^{-1}$ of iodoacetamide for 30 min at 37° C. followed by neutralization with 2 mM TCEP (final concentration). Proteins samples prepared as above were digested with trypsin (trypsin:protein ratio—1:50) overnight at 37° C. RapiGest was degraded and removed by treating the samples with 250 mM HCl at 37° C. for 1 h followed by centrifugation at 14,000 rpm for 30 min at 4° C. The soluble fraction was then added to a new tube and the peptides were extracted and desalted using Aspire RP30 desalting columns (Thermo Scientific). The trypsinized samples were labeled with isobaric tags (iTRAQ, ABSCIEX, Ross et al 2004), where each sample was labeled with a specific tag to its peptides.

Mass Spectrometry Analysis

Each set of experiments (samples 1-6; 7, 8; 9-12; 13-16; 17-20) was then pooled and fractionated using high pH reverse phase chromatography (HPRP-Xterra C18 reverse phase, 4.6 mm×10 mm 5 µm particle (Waters)). The chromatography conditions were as follows: the column was heated to 37° C. and a linear gradient from 5-35% B (Buffer A-20 mM ammonium formate pH10 aqueous, Buffer B-20 mM ammonium formate pH10 in 80% ACN-water) was applied for 80 min at 0.5 ml min$^{-1}$ flow rate. A total of 30 fractions of 0.5 ml volume where collected for LC-MS/MS analysis. Each of these fractions was analyzed by high-pressure liquid chromatography (HPLC) coupled with tandem mass spectroscopy (LC-MS/MS) using nano-spray ionization. The nanospray ionization experiments were performed using a TripleTof 5600 hybrid mass spectrometer (AB SCIEX Concord, Ontario, Canada)) interfaced with nano-scale reversed-phase HPLC (Tempo, Applied Biosystems (Life Technologies), CA, USA) using a 10 cm-180 micron ID glass capillary packed with 5 µm C18 Zorbax™ beads (Agilent Technologies, Santa Clara, Calif.). Peptides were eluted from the C18 column into the mass spectrometer using a linear gradient (5-30%) of ACN (Acetonitrile) at a flow rate of 550 µl min$^{-1}$ for 100 min. The buffers used to create the ACN gradient were: Buffer A (98% H$_2$O, 2% ACN, 0.2% formic acid, and 0.005% TFA) and Buffer B (100% ACN, 0.2% formic acid, and 0.005% TFA). MS/MS data were acquired in a data-dependent manner in which the MS1 data was acquired for 250 ms at m/z of 400 to 1250 Da and the MS/MS data was acquired from m/z of 50 to 2,000 Da. For Independent data acquisition (IDA) parameters MS1-TOF 250 ms, followed by 50 MS2 events of 25 ms each. The IDA criteria, over 200 counts threshold, charge state+2-4 with 4 s exclusion. Finally, the collected data were analyzed using Protein Pilot 4.0 (AB SCIEX) for peptide identifications and quantification.

Results for Plant Inoculation Tests

The proteomics analysis of wheat inoculated with endophytic bacteria (SYM00011, SYM00016B and SYM00057B) grown under heat stress, maize inoculated with SYM00057B grown under normal condition and soy inoculated with (SYM00057B, SYM00596, SYM00052, SYM00002, SYM00046, SYM00218, SYM00508 and SYM00940) revealed three major pathways augmented or otherwise modified by the endophyte: growth promotion, resistance against oxidative stress and mechanisms involved in symbiosis enhancement (Tables 16, 17 and 18). In some embodiments, synthetic endophyte-plant combinations exhibit alteration of multiple plant protein abundance, particularly proteins involved in stress resistance. In some embodiments, alterations comprise upregulation relative to reference agricultural plants of the following polypeptides: gi|351723089/Chalcone-flavonone isomerase 1A and gi|351723125/Glutathione S-transferase GST 24 or gi|351723089/Chalcone-flavonone isomerase 1A and gi|358248196/Polygalacturonase inhibitor 1-like precursor or gi|351723089/Chalcone-flavonone isomerase 1A and gi|359807261/Soyasaponin III rhamnosyltransferase or gi|351723089/Chalcone-flavonone isomerase 1A and gi|571453722/Programmed cell death protein 4 or gi|356536151/Alpha-L-fucosidase 2-like and gi|351723089/Chalcone-flavonone isomerase 1A or gi|356536151/Alpha-L-fucosidase 2-like and gi|351723125/Glutathione S-transferase GST 24 or gi|356536151/Alpha-L-fucosidase 2-like and gi|356559376/26S protease regulatory subunit 7-like or gi|356536151/Alpha-L-fucosidase 2-like and gi|358248196/Polygalacturonase inhibitor 1-like precursor or gi|356536151/Alpha-L-fucosidase 2-like and gi|358249064/Uncharacterized protein LOC100795412 or gi|356536151/Alpha-L-fucosidase 2-like and gi|359807261/Soyasaponin III rhamnosyltransferase or gi|356536151/Alpha-L-fucosidase 2-like and gi|571453722/Programmed cell death protein 4 or gi|356559376/26S protease regulatory subunit 7-like and gi|351723089/Chalcone-flavonone isomerase 1A or gi|356559376/26S protease regulatory subunit 7-like and gi|351723125/Glutathione S-transferase GST 24 or gi|356559376/26S protease regulatory subunit 7-like and gi|358248196/Polygalacturonase inhibitor 1-like precursor or gi|356559376/26S protease regulatory subunit 7-like and gi|359807261/Soyasaponin III rhamnosyltransferase or gi|356559376/26S protease regulatory subunit 7-like and gi|571453722/Programmed cell death protein 4 or gi|358248196/Polygalacturonase inhibitor 1-like precursor and gi|351723125/Glutathione S-transferase GST 24 or gi|358249064/Uncharacterized protein LOC100795412 and gi|351723089/Chalcone-flavonone isomerase 1A or gi|358249064/Uncharacterized protein LOC100795412 and gi|351723125/Glutathione 5-transferase GST 24 or gi|358249064/Uncharacterized protein LOC100795412 and gi|356559376/26S protease regulatory subunit 7-like or gi|358249064/Uncharacterized protein LOC100795412 and gi|358248196/Polygalacturonase inhibitor 1-like precursor or gi|358249064/Uncharacterized protein LOC100795412 and gi|359807261/Soyasaponin III rhamnosyltransferase or gi|358249064/Uncharacterized protein LOC100795412 and gi|571453722/Programmed cell death protein 4 or gi|359807261/Soyasaponin III rhamnosyltransferase and gi|351723125/Glutathione S-transferase GST 24 or gi|359807261/Soyasaponin III rhamnosyltransferase and gi|358248196/Polygalacturonase inhibitor 1-like precursor or gi|571453722/Programmed cell death protein 4 and gi|351723125/Glutathione S-transferase GST 24 or gi|571453722/Programmed cell death protein 4 and gi|358248196/Polygalacturonase inhibitor 1-like precursor or gi|571453722/Programmed cell death protein 4 and gi|359807261/Soyasaponin III rhamnosyltransferase.

In some embodiments, synthetic endophyte-plant combinations exhibit altered abundance of two or more plant proteins that are each involved in distinct beneficial activities in the plant (e.g., plant growth promotion, resistance to stress, or symbiosis). In some embodiments, alterations comprise upregulation relative to reference agricultural plants of the following polypeptides: gi|351723615/Aspartate aminotransferase glyoxysomal isozyme AAT1 precursor and gi|356508869/Lysosomal alpha-mannosidase-like or gi|351723615/Aspartate aminotransferase glyoxysomal isozyme AAT1 precursor and gi|571436840/Pectinesterase/pectinesterase inhibitor 18-like or gi|356536151/Alpha-L-fucosidase 2-like and gi|351723615/Aspartate aminotransferase glyoxysomal isozyme AAT1 precursor or gi|356536151/Alpha-L-fucosidase 2-like and gi|356508869/Lysosomal alpha-mannosidase-like or gi|356536151/Alpha-L-fucosidase 2-like and gi|358248512/Uncharacterized protein LOC100796978 or gi|356536151/Alpha-L-fucosidase 2-like and gi|571436840/Pectinesterase/pectinesterase inhibitor 18-like or gi|358248512/Uncharacterized protein LOC100796978 and gi|356508869/Lysosomal alpha-mannosidase-like or gi|358248512/Uncharacterized protein LOC100796978 and gi|571436840/Pectinesterase/pectinesterase inhibitor 18-like or gi|358249064/Uncharacterized protein LOC100795412 and gi|351723615/Aspartate aminotransferase glyoxysomal isozyme AAT1 precursor or gi|358249064/Uncharacterized protein LOC100795412 and gi|356508869/Lysosomal alpha-mannosidase-like or gi|358249064/Uncharacterized protein LOC100795412 and gi|358248512/Uncharacterized protein LOC100796978 or gi|358249064/Uncharacterized protein LOC100795412 and gi|571436840/Pectinesterase/pectinesterase inhibitor 18-like.

In some embodiments, synthetic endophyte-plant combinations exhibit altered abundance of two or more plant proteins that are each involved in distinct beneficial activities in the plant (e.g., plant growth promotion, resistance to stress, or symbiosis). In some embodiments, alterations comprise upregulation relative to reference agricultural plants of the following polypeptides: gi|351723615/Aspartate aminotransferase glyoxysomal isozyme AAT1 precursor, gi|356505888/RuBisCO-associated protein-like, gi|571470673/Peroxisomal (S)-2-hydroxy-acid oxidase GLO1, gi|356563759/L-arabinokinase-like isoform 1, gi|356558075/Cytosolic triosephosphate isomerase, gi|351724869/Uncharacterized protein LOC100306662, gi|356562473/Xylose isomerase [*Glycine max*], gi|356563694/ATP synthase protein MI25-like, gi|358248540/Uncharacterized protein LOC100778245, gi|359807469/Molecule involved in rac1 cell signaling, gi|358249004/Uncharacterized protein LOC100792337, gi|571466979/Polyphenol oxidase A1, chloroplastic, gi|356534524/40S ribosomal protein S17-like in combination with down-regulation relative to reference agricultural plants of the following polypeptides: gi|571440773/Villin-3-like isoform X4, gi|356509275/Glutamate synthase [NADH], amyloplastic-like, gi|356506969/Coiled-coil domain-containing protein 124-like, gi|571521870/Nuclear pore anchor-like, gi|571440773/Villin-3-like isoform X4, gi|356509275/Glutamate synthase [NADH], amyloplastic-like, gi|356506969/Coiled-coil domain-containing protein 124-like, gi|571521870/Nuclear pore anchor-like.

In some embodiments, synthetic endophyte-plant combinations exhibit altered abundance of two or more plant proteins that are each involved in distinct beneficial activities in the plant (e.g., plant growth promotion, resistance to stress, or symbiosis). In some embodiments, alterations comprise down regulation relative to reference agricultural plants of the following polypeptides: gi|356506190/Transketolase, chloroplastic and gi|356509275/Glutamate synthase [NADH], amyloplastic-like or gi|356506190/Transketolase, chloroplastic and gi|356516458/Staphylococcal nuclease domain-containing or gi|356506190/Transketolase, chloroplastic and gi|356533407/Embryonic protein DC-8-like or gi|356506190/Transketolase, chloroplastic and gi|356535993/Beta-conglycinin, alpha chain or gi|356506190/Transketolase, chloroplastic and gi|356575855/Beta-conglycinin, beta chain-like or gi|356506190/Transketolase, chloroplastic and gi|571477629/Low-temperature-induced 65 kDa Prot. or gi|356509275/Glutamate synthase [NADH], amyloplastic-like and gi|356516458/Staphylococcal nuclease domain-containing or gi|356509275/Glutamate synthase [NADH], amyloplastic-like and gi|356533407/Embryonic protein DC-8-like or gi|356509275/Glutamate synthase [NADH], amyloplastic-like and gi|356535993/Beta-conglycinin, alpha chain or gi|356509275/Glutamate synthase [NADH], amyloplastic-like and gi|356575855/Beta-conglycinin, beta chain-like or gi|356509275/Glutamate synthase [NADH], amyloplastic-like and gi|571477629/Low-temperature-induced 65 kDa prot. or gi|356533407/Embryonic protein DC-8-like and gi|356535993/Beta-conglycinin, alpha chain or gi|356533407/Embryonic protein DC-8-like and gi|356575855/Beta-conglycinin, beta chain-like or gi|356533407/Embryonic protein DC-8-like and gi|571477629/Low-temperature-induced 65 kDa prot. or gi|356575855/Beta-conglycinin, beta chain-like and gi|356535993/Beta-conglycinin, alpha chain or gi|571477629/Low-temperature-induced 65 kDa prot. and gi|356535993/Beta-conglycinin, alpha chain or gi|571477629/Low-temperature-induced 65 kDa prot. and gi|356575855/Beta-conglycinin, beta chain-like.

TABLE 16

Proteins showing differential levels of expression under heat stress in endophyte-inoculated wheat (cv. Briggs) seedlings relative to not-inoculated control seedlings.
ALTERED PROTEIN PRODUCTION IN RESPONSE TO INOCULATION WITH BACTERIAL SEED ENDOPHYTES

| | | Growth promotion | | | |
| --- | --- | --- | --- | --- | --- |
| | | | Ratio Treatment/Control (fold changes) | | |
| Accession # | Gene name | Pathway | SYM00011 | SYM00016B | SYM00057B |
| gi|474293349 | Acid beta-fructofuranosidase | mobilization of sucrose | 0.5-1 | 1-2 | 1-2 |
| gi|473798701 | ATP synthase subunit beta, mitochondrial | ATP synthesis | 1-2 | 1-2 | |
| gi|473945263 | Fructan 1-exohydrolase | mobilization of fructans | | | 1-2 |
| gi|473798921 | Glutamine synthetase cytosolic isozyme 1-2 | Amino acid biosynthesis | | 1-2 | 1-2 |
| gi|474427549 | Dynamin-related protein 1E | Cell division | 1-2 | 1-2 | 1-2 |
| gi|474154210 | Histone H1 | Cell division | 1-2 | 1-2 | 1-2 |
| gi|474396419 | Histone H1 | Cell division | | 1-2 | 1-2 |
| gi|474315053 | Histone H2A | Cell division | 1-2 | 1-2 | >2 |
| gi|474114390 | Histone H2A | Cell division | | | 1-2 |
| gi|474408930 | Histone H2A.1 | Cell division | 1-2 | | >2 |
| gi|474247555 | Protein H2A.7 | Cell division | 1-2 | 0.5-1 | |
| gi|474400621 | Histone H4 | Cell division | 1-2 | | 1-2 |
| gi|474160133 | Serine carboxypeptidase-like protein | Amino acid release | 1-2 | 1-2 | 1-2 |
| gi|474397165 | Serine carboxypeptidase-like 51 | Amino acid release | >2 | 1-2 | |
| gi|474449933 | Pectinesterase 1 | Cell wall remodeling | 1-2 | | >2 |
| gi|474193958 | Peptidyl-prolyl cis-trans isomerase CYP40 | Juvenile phase of vegetative development | 1-2 | >2 | >2 |
| gi|473956589 | Ribonucleoside-diphosphate reductase | DNA synthesis | 0.1-0.5 | 0.1-0.5 | >10 |

TABLE 16-continued

Proteins showing differential levels of expression under heat stress in endophyte-inoculated wheat (cv. Briggs) seedlings relative to not-inoculated control seedlings.
ALTERED PROTEIN PRODUCTION IN RESPONSE TO INOCULATION WITH BACTERIAL SEED ENDOPHYTES

| | | | | | |
|---|---|---|---|---|---|
| gi|474326915 | Villin-4 | Cell elongation | >2 | >10 | >2 |
| gi|474156626 | Glutenin, low molecular weight subunit | Protein storage - affected by heat | 1-2 | 1-2 | |

| | | | Ratio Treatment/Control (fold changes) | | |
|---|---|---|---|---|---|
| Accession # | Gene name | Function | SYM00011 | SYM00016B | SYM00057B |
| Resistance against abiotic stress | | | | | |
| gi|474449933 | Pectinesterase 1 | Resistance to drought | 1-2 | | >2 |
| gi|474381202 | Peroxiredoxin Q, chloroplastic | Resistance to oxidative stress | 0.5-1 | 0.5-1 | >2 |
| gi|474299547 | Glutathione S-transferase DHAR3, chloroplastic | Resistance to oxidative stress | 1-2 | 1-2 | >2 |
| gi|474276683 | Peroxidase 12 | Resistance to oxidative stress | 1-2 | 1-2 | 1-2 |
| gi|474414579 | 3-hydroxybenzoate 6-hydroxylase 1 | Degradation of toxic organic compounds | 1-2 | >2 | 1-2 |
| gi|474323467 | BAHD acyltransferase DCR | Cutin formation - dessication resistance | 1-2 | 1-2 | 0.1-0.5 |
| gi|473999626 | 5'-methylthioadenosine/S-adenosylhomocysteine nucleosidase | Negative feedback on ethylene production | 0.5-1 | 0.5-1 | 0.5-1 |
| gi|474326305 | Aldehyde dehydrogenase family 2 member C4 | Controls acetaldehyde accumulation | 0.5-1 | 0.5-1 | 0.5-1 |
| gi|474041937 | putative protein phosphatase 2C 45 | Regulates ABA signaling | | 0.5-1 | |
| gi|473894812 | DEAD-box ATP-dependent RNA helicase 40 | mRNA decay and ribosome biogenesis | | 0.1-0.5 | |
| Symbiosis enhancement | | | | | |
| gi|474407144 | Enolase 1 | Glycolisis of sugars required by endophyte | 0.5-1 | 0.5-1 | |
| gi|474119301 | Protochlorophyllide reductase B, chloroplastic | Affected by symbiosis | | 0.5-1 | |
| gi|474213532 | Elicitor-responsive protein 1 | Microbe response signaling | 0.5-1 | 0.5-1 | 1-2 |

TABLE 17

Proteins showing differential levels of expression under normal condition in endophyte-inoculated maize (Blue River Hybrids 40R73) seedlings relative to non-inoculated control seedlings.
ALTERED PROTEIN PRODUCTION IN RESPONSE TO INOCULATION WITH BACTERIAL SEED ENDOPHYTES

| | | | Ratio Treatment/Control (fold changes) |
|---|---|---|---|
| Accession # | Gene name | Pathway | SYM00057B vs. control |
| Growth promotion | | | |
| gi|413950290 | putative peptidyl-prolyl cis-trans isomerase | Organ development | >2-fold |
| gi|414876902 | ATP-dependent Clp protease proteolytic subunit | Chloroplast component | >2-fold |
| gi|413948820 | Translation elongation factor Tu isoform 3 | Protein biosynthesis | 1-2 fold |
| gi|414878150 | Chaperone protein dnaJ 15 | Positive gravitropism | <0.5-fold |
| gi|413954599 | translation elongation/initiation factor | Embryo development ends seed dormancy | <0.5-fold |

| Accession # | Gene name | Function | SYM00057B vs. control (fold change) |
|---|---|---|---|
| Resistance against abiotic stress | | | |
| gi|414867473 | Glutathione S-transferase GSTU6 | Resistance to oxidative stress | 1-2 |
| gi|414876903 | Calmodulin2 | ABA-induced antioxidant defense | <0.5 |
| gi|413920116 | Ras protein Rab-18 | ABA inducible, accumulates in cold stress | 0.5-1 |
| gi|413926351 | DNA repair protein RAD23-1 isoform 3 | Nucleotide-excision repair | 0.5-1 |
| Symbiosis enhancement | | | |
| gi|413920282 | Hydroquinone glucosyltransferase | Upregulated in Rhizobia symbiosis | >10 |
| gi|413939151 | replication factor C subunit 3 | Negative regulation of defense response | >10 |
| gi|413946904 | NEDD8-activating enzyme E1 catalytic subunit | Protein neddylation - microbe response | >10 |

TABLE 17-continued

Proteins showing differential levels of expression under normal condition in endophyte-inoculated maize (Blue River Hybrids 40R73) seedlings relative to non-inoculated control seedlings.
ALTERED PROTEIN PRODUCTION IN RESPONSE TO INOCULATION WITH BACTERIAL SEED ENDOPHYTES

| | | | |
|---|---|---|---|
| gi\|413951445 | delta3,5-delta2,4-dienoyl-CoA isomerase | Peroxisome component - defense | >10 |
| gi\|413925737 | Proteasome subunit alpha type | Response to compatible symbiotic bacteria | >2 |
| gi\|413957021 | Ras protein RHN1 | Legume homolog involved in nodulation | >2 |
| gi\|414875813 | Early nodulin 20 | Root nodule formation | >2 |
| gi\|414886632 | Putative plant regulator RWP-RK family protein | Nodule inception protein | 1-2 |
| gi\|413955359 | putative metacaspase family protein | Programmed cell death regulation | 0.5-1 |
| gi\|413920552 | win1 | Defense response to bacteria and fungi | <0.5 |
| gi\|413948744 | protein brittle-1 | Response to nematodes | <0.5 |
| gi\|414869634 | Proteasome subunit beta type | Regulation of hypersensitive response | 0.5-1 |

TABLE 18

Proteins showing differential levels of expression under normal condition in endophyte-inoculated soybean seedlings relative to non-inoculated control seedlings.
ALTERED PROTEIN PRODUCTION IN RESPONSE TO INOCULATION WITH BACTERIAL SEED ENDOPHYTES

| Accession number | Gene name | Pathway | Growth promotion | | | | | | | |
|---|---|---|---|---|---|---|---|---|---|---|
| | | | SYM0057B | SYM00596 | SYM00052 | SYM00002 | SYM00046 | SYM00218 | SYM00508 | SYM00940 |
| | | | Ratio Treatment/Control (fold change) | | | | | | | |
| gi351726277 | Arginase | Proline biosynthesis | | | | | | 1-2 | | 1-2 |
| gi359806184 | Uncharacterized protein LOC100812934 | RNA binding domain | >2 | >2 | | | | | | |
| gi359806656 | Stem 31 kDa glycoprotein precursor | Storage | >2 | | | | 1-2 | 1-2 | | 1-2 |
| gi359807195 | Uncharacterized protein LOC100798112 | Membrane fatty acid translocation | | >2 | | | | | | |
| gi356539666 | Cinnamoyl-CoA reductase 1 | Cell wall biosynthesis | | | >2 | >2 | | | | |
| gi351724869 | Uncharacterized protein LOC100306662 | Contains a trypsing inhibitor domain | | | >2 | >2 | 1-2 | 1-2 | | 1-2 |
| gi356505888 | RuBisCO-associated protein-like | Photosynthesis | >2 | | >2 | >2 | | | | |
| gi571524597 | 25.3 kDa vesicle transport protein-like | Boron intake | >2 | >2 | | | | | | |
| gi351723027 | Stearoyl-ACP desaturase 2 | Fatty acid biosynthesis | >2 | >2 | | | 1-2 | | | |
| gi571470673 | Peroxisomal (S)-2-hydroxy-acid oxidase GLO1 | Photorespiration | >2 | >2 | | | | 0.5-1 | >2 | |
| gi358248468 | Uncharacterized protein LOC100787970 | Epimerase domain, sugar metabolism | >2 | >2 | | | | | | |
| gi356526314 | Coatomer subunit beta-1-like | Intracellular trafficking | >2 | | | | | | | |
| gi571476759 | Sucrose synthase-like isoform X2 | Carbohydrate metabolism | >2 | | | | | | 0.5-1 | |
| gi356516186 | 60S ribosomal protein L9-like | Protein synthesis | >2 | >2 | | | | | | |
| gi351723535 | Uncharacterized protein LOC100305619 | Similar Ribosomal_L16; Protein synthesis | 1-2 | | | | | | | |
| gi356549722 | 50S ribosomal protein L3-2, chloroplastic-like | Protein synthesis | 1-2 | >2 | | | | | | |
| gi571568318 | Exocyst complex component SEC5A-like | Cell growth | | >2 | | | | | | |
| gi356555176 | Protein PAT1 homolog 1-like | Mitotic chromosome segregation | | >2 | | | | | | |
| gi351722913 | Protein disulfide isomerase-like precursor | Protein synthesis | | | | >2 | 1-2 | | | |
| gi356548745 | Trafficking protein particle complex | Unknown | >2 | | | | | | | |
| gi356563759 | L-arabinokinase-like isoform 1 | Cell wall biosynthesis | >2 | | 1-2 | >2 | | | 1-2 | |
| gi356562473 | Xylose isomerase [Glycine max] | Cell wall biosynthesis | | | >2 | >2 | >2 | 0.5-1 | 1-2 | |
| gi356563694 | ATP synthase protein MI25-like | Membrane bound proton transport | | | >2 | >2 | 1-2 | | | |
| gi351723615 | Aspartate aminotransferase glyoxysomal isozyme AAT1 precursor | Carbon and nitrogen metabolism | 1-2 | | >2 | >2 | >2 | | >2 | 1-2 |
| gi571495263 | Protein disulfide-isomerase 5-4-like | Protein folding | | | >2 | | | | | |

TABLE 18-continued

Proteins showing differential levels of expression under normal condition in endophyte-inoculated soybean seedlings relative to non-inoculated control seedlings.

ALTERED PROTEIN PRODUCTION IN RESPONSE TO INOCULATION WITH BACTERIAL SEED ENDOPHYTES

| GI | Protein | Function | | | | |
|---|---|---|---|---|---|---|
| gi\|358248540 | Uncharacterized protein LOC100778245 | Sieve tube occlusion | | >2 | >2 | 1-2 |
| gi\|358248512 | Uncharacterized protein LOC100796978 | Domain involved in fatty acid biosynthesis | 1-2 | >2 | 1-2 | |
| gi\|356534817 | Exocyst complex component EXO70A1-like | Vesicle trafficking | | >2 | 1-2 | |
| gi\|356543530 | UDP-D-apiose/UDP-D-xylose synthase 2-like | Cell wall integrity | | >2 | | |
| gi\|359807265 | 60S ribosomal protein L35a | Protein Synthesis | | | >2 | 1-2 |
| gi\|356531794 | V-type proton ATPase subunit d2-like isoform 1 | Metabolism | >2 | | >2 | 1-2 |
| gi\|571517750 | Aminomethyltransferase, mitochondrial-like | Metabolism | 1-2 | | >2 | 1-2 |
| gi\|359807469 | Molecule involved in rac1 cell signaling | Cell cycle regulation | | | >2 | 1-2 |
| gi\|356555809 | Glycosyltransferase | Growth Factor modulation | | | >2 | |
| gi\|356538962 | Protein phosphatase methylesterase 1 | Regulates phosphatase-2 | | | >2 | |
| gi\|351727711 | Probable 60S ribosomal protein L27a | Protein Synthesis | | | >2 | |
| gi\|356558075 | Cytosolic triosephosphate isomerase | Glycolosis, Starch Synthesis Modulation | >2 | | >2 | 1-2 |
| gi\|356548593 | Ribosome biogenesis regulatory protein | Protein Synthesis | | | >2 | |
| gi\|356531391 | Probable beta-D-xylosidase 6 | Cell wall biosynthesis | | | >2 | |
| gi\|571465945 | Mitochondrial ATP synthase subunit delta | Respiration | | | >2 | |
| gi\|356555162 | Ribosomal L1 domain-containing protein 1 | Protein Synthesis | | | 1-2 | 0.5-1 |
| gi\|356525010 | V-type proton ATPase subunit F | Respiration | 1-2 | | 1-2 | |
| gi\|571445972 | Pre-mRNA-processing factor 39-like isoform X3 | RNA export Protein Synthesis | | | 1-2 | |
| gi\|356570229 | Elongation factor 1-alpha isoform 1 | Cell growth and differentiation | | | 1-2 | 1-2 |
| gi\|356500305 | Probable subtilisin-like serine protease | Cell Cycle, PCD | 1-2 | | 1-2 | >2 |
| gi\|356531651 | Chloriplastic 50S ribosomal protein L1 | Protein Synthesis | | | 1-2 | |
| gi\|356568070 | Multiple inositol polyphosphate phosphatase | Seed Development | | | 1-2 | |
| gi\|356575355 | Calreticulin | Calcium ion signaling and protein folding | | | 1-2 | |
| gi\|356523720 | Mitochondrial-processing peptidase subunit alpha-like | Respiration and mitochondrial growth | | | 1-2 | |
| gi\|358249364 | Uncharacterized protein LOC100812318 | Phloem development | 1-2 | | | 1-2 |
| gi\|356532109 | 2,3-bisphosphoglycerate-independent phosphoglycerate | Glycolysis | | | 1-2 | |
| gi\|356525776 | SC35-like Protein | Pre-mRNA Splicing | 0.5-1 | | 1-2 | 1-2 |
| gi\|351726214 | calreticulin-1 precursor | Calcium ion signaling and protein folding | 0.5-1 | | 1-2 | |

TABLE 18-continued

Proteins showing differential levels of expression under normal condition in endophyte-inoculated soybean seedlings relative to non-inoculated control seedlings.

ALTERED PROTEIN PRODUCTION IN RESPONSE TO INOCULATION WITH BACTERIAL SEED ENDOPHYTES

| ID | Name | Function | | | | | | | |
|---|---|---|---|---|---|---|---|---|---|
| gi\|359807453 | Ribulose bisphosphate carboxylase small chain | Calvin cycle | | | | | | 1-2 | 1-2 | 1-2 |
| gi\|356511113 | Anthocyanidin 3-O-glucosyltransferase 5-like | Glucose Transfer | | | 1-2 | | | | | |
| gi\|571560814 | Conserved oligomeric Golgi complex subunit 4-like isoform X2 | Intracellular trafficking | | 1-2 | 1-2 | 1-2 | | | 1-2 | 1-2 |
| gi\|571490167 | Uncharacterized protein LOC100816765 isoform X1 | Cellulose biosynthesis | | | 1-2 | 1-2 | | | | |
| gi\|571563805 | Glucosidase 2 subunit beta-like | Carbohydrate metabolism | | | | | 1-2 | 1-2 | | 1-2 |
| gi\|356531894 | Isopentenyl-diphosphate Delta-isomerase II | Isoprenoid biosynthesis | | | | | 1-2 | 1-2 | 1-2 | |
| gi\|356552396 | Galactinol-sucrose galactosyltransferase | Upregulated during seed filling | | | | | 0.5-1 | 0.5-1 | 0.5-1 | 0.5-1 |
| gi\|356567472 | Probable pectate lyase 5-like | Expressed late in pollen development | | | | | 0.5-1 | 0.5-1 | | 0.5-1 |
| gi\|571521870 | Nuclear pore anchor-like | mRNA export, telomere organization | | | 0.5-1 | 0.5-1 | | | | 0.5-1 |
| gi\|356575418 | Anthranilate synthase component I-2 | Aminoacid biosynthesis | | | 0.5-1 | 0.5-1 | | | 0.5-1 | 0.5-1 |
| gi\|571440773 | Villin-3-like isoform X4 | Seed storage protein | 0.5-1 | | 0.5-1 | 0.5-1 | 0.5-1 | | | |
| gi\|356575855 | Beta-conglycinin, beta chain-like | Seed storage protein | | | 0.5-1 | <0.5 | 0.5-1 | | | |
| gi\|356531441 | Uncharacterized protein LOC100797009 | Unknown, Nucleic acid binding domain | 0.5-1 | <0.5 | | | | | | |
| gi\|407971020 | Glycinin G1 precursor | Protein storage | 0.5-1 | | 0.5-1 | | | | 0.5-1 | 0.5-1 |
| gi\|356516458 | Staphylococcal nuclease domain-containing | Salt-responsive phosphoprotein | | | <0.5 | | <0.5 | | | |
| gi\|356533517 | 60S ribosomal protein L24-like | Component of ribosomes, protein synthesis | <0.5 | <0.5 | | | | | | |
| gi\|351721724 | Uncharacterized protein LOC100306336 | Synaptobrevin/VAMP-like protein | | <0.5 | | | | | | |
| gi\|356501546 | Dihydrolipoyllysine-residue succinyltransferase component of 2-oxoglutarate dehydrogenase complex 2 | Glycolytic and Tricarboxylic acid pathways | <0.5 | | | | | | | 1-2 |
| gi\|351726285 | Uncharacterized protein LOC100305625 | Contains RNAse E catalytic domain | | <0.5 | | | | | <0.5 | 1-2 |
| gi\|356506969 | Coiled-coil domain-containing protein 124-like | Unknown | <0.5 | <0.5 | | | | | | 0.5-1 |
| gi\|351723585 | HMG I/Y like protein | Nitrogen metabolism | | | | | | 0.5-1 | | 0.5-1 |
| gi\|525507423 | Allergen Gly m Bd 28K precursor | Protein storage in cotyledons | | | | | | <0.5 | | <0.5 |
| gi\|356509275 | Glutamate synthase [NADH], amyloplastic-like | Ammonium derived reserves mobilization | 0.5-1 | | <0.5 | | <0.5 | 0.5-1 | 0.5-1 | 0.5-1 |

TABLE 18-continued

Proteins showing differential levels of expression under normal condition in endophyte-inoculated soybean seedlings relative to non-inoculated control seedlings.
ALTERED PROTEIN PRODUCTION IN RESPONSE TO INOCULATION WITH BACTERIAL SEED ENDOPHYTES

| Resistance against abiotic stress | | | Ratio Treatment/Control | | | | | | | |
|---|---|---|---|---|---|---|---|---|---|---|
| Accession number | Gene name | Function | SYM00057B | SYM00596 | SYM00052 | SYM00002 | SYM00046 | SYM00218 | SYM00508 | SYM00940 |
| gi\|356532293 | Plastid-lipid-associated prot., chloroplastic-like | Enhanced development under stress | | | | >2 | 1-2 | | | |
| gi\|358249004 | Uncharacterized protein LOC100792337 | CutA domain involved in copper tolerance | | | >2 | >2 | >2 | | | |
| gi\|351727160 | Uncharacterized protein LOC100306620 | Antioxidant in organelles exposed to ROS | >2 | | | | | | >2 | |
| gi\|351726968 | Uncharacterized protein LOC100500475 | Heat-Shock Protein domain | 1-2 | | | | >2 | | | |
| gi\|351723027 | Stearoyl-ACP desaturase 2 | Upregulated in cold temperature | >2 | | | | 1-2 | | | |
| gi\|351725976 | Heat shock protein 90-2 | Stress response | | | | | | 1-2 | | 1-2 |
| gi\|571466979 | Polyphenol oxidase A1, chloroplast | Wounding response, disease resistance | 1-2 | | | >2 | >2 | 1-2 | | 1-2 |
| gi\|351727799 | Uncharacterized protein LOC100305838 | Pathogenesis-related BetvI domain | | | | >2 | | | | |
| gi\|356564319 | Thioredoxin H-type | Defense against oxidative damage | 1-2 | 1-2 | | | >2 | 0.5-1 | 0.5-1 | 1-2 |
| gi\|571727843 | Seed linoleate 9S-lipoxygenase-3 | Pest resistance and response to wounding | | | | | | 0.5-1 | | 0.5-1 |
| gi\|571528717 | Glutathione reductase, cytosolic isoform X2 | Upregulated under cold stress | 1-2 | | | | | | | |
| gi\|359807279 | Uncharacterized protein LOC100811170 | Defense against oxidative damage | | | | | >2 | 1-2 | | 1-2 |
| gi\|356534524 | 40S ribosomal protein S17-like | Upregulated under salt stress | 1-2 | >2 | 1-2 | >2 | 1-2 | | | |
| gi\|356526625 | Probable importin-7 homolog | Abiotic stress response | >2 | | | | | | >2 | |
| gi\|356522025 | Pyrophosphate-fructose6-phosphate1-phosphotransferase | Nutrient stress | | | | | | | >2 | |
| gi\|358248934 | Uncharacterized protein LOC100802108 | Stress response | | | | | | 1-2 | >2 | |
| gi\|356526803 | Probable mucleoredoxin 1-like isoform X1 | Defense against drought/oxidative damage | | | | | | | >2 | |
| gi\|351723089 | Chalcone-flavonone isomerase 1A | Upregulated under drought stress | 1-2 | | | >2 | 1-2 | 0.5-1 | >2 | |
| gi\|351723659 | Probable aldo-keto reductase 1 [Glycine max] | Response to heavy metal/herbicide stress | | | | | | | 1-2 | |
| gi\|359807506 | Uncharacterized protein LOC100784252 | Stress response | 1-2 | | | | | 1-2 | 1-2 | |
| gi\|356539794 | Glutamate decarboxylase 1-like | Stress Response | | | | | >2 | | | |
| gi\|571528788 | UDP-glycosyltransferase 74E2-like | Stress Response | | | | | >2 | | | |
| gi\|356571134 | Heterogeneous nuclear ribonucleoprotein A3 | Abiotic stress response | | >2 | | | | | | |
| gi\|356526320 | ATP synthase subunit epsilon | Abiotic stress (drought) response | | >2 | | | | | | |
| gi\|356526019 | Transmembrane 9 superfamily member 4-like | Salt stress tolerance | >2 | >2 | | | | | | 1-2 |

TABLE 18-continued

Proteins showing differential levels of expression under normal condition in endophyte-inoculated soybean seedlings relative to non-inoculated control seedlings.

ALTERED PROTEIN PRODUCTION IN RESPONSE TO INOCULATION WITH BACTERIAL SEED ENDOPHYTES

| | | | | | |
|---|---|---|---|---|---|
| gi\|571449076 | Polyadenylate-binding protein 8 isoform X3 | Salt stress tolerance | >2 | | 1-2 |
| gi\|571443884 | DEAD-box ATP-dependent RNA helicase 8-like | DNA repair under abiotic stress | >2 | 0.5-1 | 0.5-1 |
| gi\|363806992 | V-type proton ATPase catalytic subunit A-like | Stress response | >2 | | 1-2 |
| gi\|351720981 | Glucan endo-1,3-beta-glucosidase precursor | Upregulated under nematode stress | | >2 | 1-2 |
| gi\|571493372 | Anamorsin homolog | Defense against oxidative damage | | 1-2 | |
| gi\|359807560 | Mitochondrial outer membrane protein | Respiration, defense against oxidative dmg | 1-2 | 1-2 | 1-2 |
| gi\|351724085 | Glutathione S-transferase family protein | Defense against oxidative damage | 1-2 | 1-2 | |
| gi\|363814589 | Peroxidase precursor | Plant defense | | 1-2 | 1-2 |
| gi\|356539207 | Apoptosis-inducing factor homolog A-like | Upregulated under flood stress | | 1-2 | 1-2 |
| gi\|358249134 | Uncharacterized protein LOC100782451 | Defense against oxidative damage | | | 1-2 |
| gi\|358576221 | Aquaporin PIP2-1-like | Water stress | | 1-2 | |
| gi\|351720940 | Glutathione peroxidase family | Defense against oxidative damage | | 1-2 | |
| gi\|356507345 | Chaperone protein ClpB4, mitochondrial-like | Heat shock resistance | 0.5-1 | 1-2 | 0.5-1 |
| gi\|356518571 | 26S protease regulatory subunit 10B | Chaperone and ATPase subunit of protease | 1-2 | 1-2 | |
| gi\|358248990 | 83 kDa Heat Shock Protein | Stress response | | 1-2 | 1-2 |
| gi\|351734408 | Glutaredoxin (GRX) family similar to human | Redox and defense against oxidative dmg | 1-2 | 1-2 | |
| gi\|571501181 | Proton pump-interactor 1-like isoform X2 | Stress response | | >2 | 1-2 |
| gi\|351723857 | Peroxisomal betaine-aldehyde dehydrogenase | Salt tolerance | >2 | 1-2 | 1-2 |
| gi\|356519792 | Flavonoid 3'-monooxygenase | Abiotic stress (drought) response | >2 | >2 | 1-2 |
| gi\|351721446 | uncharacterized protein LOC100499951 | Defense against oxidative damage | | >2 | |
| gi\|351722971 | Phytochrome A | Regulates isoflavone levels | >2 | >2 | |
| gi\|358249004 | Uncharacterized protein LOC100792337 | Divalent ion tolerance protein | >2 | >2 | |
| gi\|351724819(6) | Polygalacturonase inhibitor 1-like precursor | Inhibit polygalacturonase | 1-2 | >2 | |
| gi\|356550171 | Beta-galactosidase 8-like isoform 1 | Lipid degradation | 1-2 | 1-2 | 1-2 |
| gi\|356552408 | Transmembrane 9 superfamily member 4-like | Copper balance | >2 | 1-2 | |
| gi\|356556396 | Aldehyde dehydrogenase family 7 member | Upregulated under salt stress | >2 | | |
| gi\|356505665 | S-adenosylmethionine synthase 1-like isoform 1 | Resistance to abiotic stress | 1-2 | 1-2 | |
| gi\|356563248 | FAM10 family protein At4g22670-like | Heat shock resistance | 1-2 | | |
| gi\|356539060 | Vacuolar-sorting receptor 1-like | Intracellular trafficking | >2 | 1-2 | |

TABLE 18-continued

Proteins showing differential levels of expression under normal condition in endophyte-inoculated soybean seedlings relative to non-inoculated control seedlings.

ALTERED PROTEIN PRODUCTION IN RESPONSE TO INOCULATION WITH BACTERIAL SEED ENDOPHYTES

| GI | Protein | Function | | | | | | |
|---|---|---|---|---|---|---|---|---|
| gi\|356636151 | Alpha-L-fucosidase 2-like | Upregulated under stress | 1-2 | 1-2 | 1-2 | 1-2 | 1-2 | 1-2 |
| gi\|359807261 | Soyasaponin III rhamnosyltransferase | General stress response | | 1-2 | 1-2 | 1-2 | 1-2 | 1-2 |
| gi\|356575387 | Prolyl endopeptidase-like | Abiotic stress (drought) response | 1-2 | | 1-2 | 1-2 | 0.5-1 | 1-2 |
| gi\|358249064 | Uncharacterized protein LOC100795412 | General abiotic resistance | >2 | 1-2 | 1-2 | 1-2 | 1-2 | 1-2 |
| gi\|571439125 | Glutathione reductase, cytosolic-like | Oxidative stress response | | | | | 1-2 | 1-2 |
| gi\|356559376 | 26S protease regulatory subunit 7-like | Innate Immunity of plants | 1-2 | | 1-2 | 1-2 | | 1-2 |
| gi\|571517750 | Aminomethyltransferase, mitochondrial-like | Breakdown of drought stress metabolite | 1-2 | | | >2 | 1-2 | 1-2 |
| gi\|356569099 | Uncharacterized protein LOC100816075 | Defense against oxidative damage | 1-2 | | | | 1-2 | 1-2 |
| gi\|351726848 | Seed linoleate 9S-lipoxygenase | General stress response | 1-2 | | | 0.5-1 | 1-2 | 1-2 |
| gi\|571433220 | Uncharacterized protein LOC100305891 | Dessication stress response | | | | | 1-2 | 1-2 |
| gi\|571480718 | Vacuolar (H+)-ATPase G subunit | Photosynthesis | | | | | | 1-2 |
| gi\|356572832 | MEthionine adenosyltransferase | AdoMet pathway, Growth | | | | >2 | 1-2 | 1-2 |
| gi\|356564135 | Probable subtilisin-like serine protease | Cell Cycle, PCD | | | | | 1-2 | 1-2 |
| gi\|351727803 | uncharacterized protein | Riboflavin production | | | | | 1-2 | 1-2 |
| gi\|356556866 | Probable linoleate 9S-lipoxygenase-4 | Root lateralization and defense | | | | 1-2 | | 1-2 |
| gi\|356517182 | S-norcoclaurine synthase | Secondary metabolite production | 1-2 | | 1-2 | 1-2 | 1-2 | 1-2 |
| gi\|356563300 | Probable beta-fructofuranosidase | Growth and wound response | | | | | | 1-2 |
| gi\|351727703 | Dihydroflavonol reductase | Flavanoid production/Stress Response | | | | | | 1-2 |
| gi\|351722222 | Lipoxygenase | Defense against oxidative damage | 1-2 | | | 1-2 | 1-2 | 1-2 |
| gi\|351721496 | Copper amine oxidase precursor | wound/pathogen response | | >2 | | 0.5-1 | | 1-2 |
| gi\|571497607 | Probable chloroplastic 20 kDa chaperonin | Heat-shock and stress response | | <0.5 | | 1-2 | 1-2 | 1-2 |
| gi\|356557126 | Vicianin hydrolase | Plant defense | | | | | 1-2 | 1-2 |
| gi\|571445503 | Villin-2-like protein | Structure | | | | | 1-2 | 1-2 |
| gi\|356551568 | 18.2 kDa class I heat shock protein | Stress response | | | | | 0.5-1 | 0.5-1 |
| gi\|356497361 | Chalcone Synthase | Plant defense, antimicrobial | | | | | 0.5-1 | 0.5-1 |
| gi\|356554094 | DEAD-box ATP-dependent RNA helicase 53 | Salt stress adaptation | | | | 0.5-1 | | 0.5-1 |
| gi\|351727184 | Seed maturation protein PM24, Drought tollerance | seed maturation protein PM24, Drought tollerance | | | | | | 0.5-1 |
| gi\|356575853 | Beta-conglycinin | Seed storage protein | | >2 | | | | <0.5 |
| gi\|351723125 | Glutathione S-transferase GST 24 | ROS response and Dextoxification | | | >2 | >2 | 0.5-1 | 0.5-1 |
| gi\|571455778 | Probable glutathione S-transferase | ROS response and Dextoxification | | | | | 0.5-1 | |
| gi\|351722245 | Seed maturation protein PM3 | Heat shock protein, seed maturation | | | | 0.5-1 | 0.5-1 | 0.5-1 |
| gi\|571453722 | Programmed cell death protein 4 | Abiotic stress response | | >2 | >2 | 0.5-1 | | 0.5-1 |

TABLE 18-continued

Proteins showing differential levels of expression under normal condition in endophyte-inoculated soybean seedlings relative to non-inoculated control seedlings.

ALTERED PROTEIN PRODUCTION IN RESPONSE TO INOCULATION WITH BACTERIAL SEED ENDOPHYTES

| ID | Protein | Function | C1 | C2 | C3 | C4 | C5 |
|---|---|---|---|---|---|---|---|
| gi\|571481365 | Late embryogenesis abundant protein D-34 | Dehydration tolerance, seed formation | | 0.5-1 | | 0.5-1 | <0.5 |
| gi\|351724511 | Beta-conglycinin alpha prime subunit precursor | Seed storage protein | | | | <0.5 | <0.5 |
| gi\|363814316 | ATP synthase (C/AC39) subunit | Respiration | | | | 0.5-1 | 0.5-1 |
| gi\|359807588 | NADP-Binding oxidoreductase | Respiration | | | | 0.5-1 | 0.5-1 |
| gi\|351480648 | granule bound starch synthase Ia | Carbohydrate Storage | 0.5-1 | | | 0.5-1 | 0.5-1 |
| gi\|351722615 | seed maturation protein PM24 | seed maturation protein PM24 | | | | | 0.5-1 |
| gi\|571463841 | PR10-like protein | RNA degradation | | | | | 0.5-1 |
| gi\|571472621 | 60S ribosomal protein L7-4 | protein synthesis | | | | | 0.5-1 |
| gi\|571513400 | Amyloplastic glutamate synthase [NADH] | Carbohydrate Storage | | | | | 0.5-1 |
| gi\|351722277 | P24 oleosin | Helps form oil barier to protect seeds | | | | | 0.5-1 |
| gi\|351723183 | 60S ribosomal protein L6 | Protein synthesis | | | | 0.5-1 | 0.5-1 |
| gi\|571460036 | protein disulfide-isomerase | Endosperm and seed development | | | | 0.5-1 | 0.5-1 |
| gi\|91214131 | ribosomal protein S4 | Protein synthesis | | | | 0.5-1 | |
| gi\|351725291 | Ca+2-binding EF hand protein | Cell signalling and regulation | | | | 0.5-1 | <0.5 |
| gi\|571445521 | Galactinol-sucrose galactosyltransferase 2 | Carbohydrate metabolism | 0.5-1 | | | 0.5-1 | <0.5 |
| gi\|356506190 | Transketolase, chloroplastic | Energy metabolism | 0.5-1 | 0.5-1 | 0.5-1 | 0.5-1 | |
| gi\|571560306 | Cysteine synthase-like isoform X3 | Amino acid downregulated protein. | | 0.5-1 | 0.5-1 | | |
| gi\|351493751 | Squamous cell carcinoma antigen | Possible alarm signal that stresses the plant | 1-2 | 0.5-1 | 0.5-1 | | |
| gi\|351727923 | LEA protein precursor | General abiotic resistance | 0.5-1 | | | 0.5-1 | 0.5-1 |
| gi\|351726932 | Uncharacterized protein LOC100305867 | Pathogenesis-related BetvI domain | <0.5 | | | 1-2 | 1-2 |
| gi\|356509275 | Glutamate synthase [NADH], amyloplastic-like | Amino acid downregulated protein | 0.5-1 | <0.5 | <0.5 | 0.5-1 | 0.5-1 |
| gi\|571443639 | 35 kDa seed maturation protein | Unknown, associated with drought stress | <0.5 | | | <0.5 | <0.5 |
| gi\|351724439 | Seed biotin-containing protein SBP65 | Seed maturation protein | <0.5 | | | 0.5-1 | 0.5-1 |
| gi\|356333407 | Embryonic protein DC-8-like | Seed maturation protein | <0.5 | | | <0.5 | 0.5-1 |
| gi\|571477629 | Low-temperature-induced 65 kDa prot. | Seed maturation protein | | 0.5-1 | | <0.5 | 0.5-1 |
| gi\|351720785 | Glycinin precursor | Precursor of seed storage protein | | | | 0.5-1 | 0.5-1 |
| gi\|571481071 | Nucleolar protein 14-like | Protein synthesis | | | | 0.5-1 | 0.5-1 |
| gi\|356506138 | 1a-related protein 6-like | Thermal stress response | | | | 0.5-1 | 0.5-1 |
| gi\|356509908 | Cysteine proteinase 15A-like | Stress response | | | | 0.5-1 | |
| gi\|356505489 | NPL4-like protein 1-like | Protein degradation | | | 0.5-1 | 0.5-1 | |
| gi\|356512347 | Signal recognition particle subunit SRP72-like | Targeting secretory proteins to ER | | 0.5-1 | 0.5-1 | | |
| gi\|351722383 | Glucosyltransferase | Molecular acclimation to stress | 0.5-1 | | | 0.5-1 | 0.5-1 |
| gi\|351726078 | 51 kDa seed maturation protein precursor | Upregulated during seed drying | <0.5 | | 1-2 | 0.5-1 | |
| gi\|351727923 | Lea protein precursor | Upregulated during seed drying | 0.5-1 | | | 0.5-1 | 0.5-1 |

TABLE 18-continued

Proteins showing differential levels of expression under normal condition in endophyte-inoculated soybean seedlings relative to non-inoculated control seedlings.

ALTERED PROTEIN PRODUCTION IN RESPONSE TO INOCULATION WITH BACTERIAL SEED ENDOPHYTES

| Accession | Gene name | Function | | | | | | | | |
|---|---|---|---|---|---|---|---|---|---|---|
| gi356531617 | Ubiquitin carboxyl-terminal hydrolase 24-like | Molecular acclimation to stress | | | | | | | 0.5-1 | |
| gi356516170 | Nascent polypeptide-associated complex subunit alpha-like protein 2-like | Molecular acclimation to stress | | | | | | | <0.5 | |
| gi356577005 | Enolase-phosphatase E1-like | Methionine salvage | | | | | | | <0.5 | |
| gi571482993 | Enolase-phosphatase E1-like | Methionine salvage | | | | | | | <0.5 | |
| gi351723669 | Em protein | Water stress response | <0.5 | | | | | <0.5 | | |
| gi351722444 | maturation protein pPM32 [Glycine max] | Stress response | <0.5 | | | | | 0.5-1 | | |
| gi356561627 | Low-temperature-induced 65 kDa protein-like | Water stress response | | | | | | 0.5-1 | | 0.5-1 |
| gi356542936 | Riboflavin synthase-like | Stress response | 0.5-1 | | | | | 0.5-1 | | |
| gi356535993 | Beta-conglycinin, alpha chain | Seed storage protein | | | | | | <0.5 | | <0.5 |
| gi356548291 | Ethylene-insensitive protein | Stress response | | | | <0.5 | | | | |
| gi356516335 | Carbamoyl-phosphate synthase small chain | AMF nitrogen and phosphorus metabolism | >2 | | | | | | | |

Symbiosis enhancement

| Accession number | Gene name | Function | SYM00057B | SYM00596 | SYM00052 | SYM00002 | SYM00046 | SYM00218 | SYM00508 | SYM00940 |
|---|---|---|---|---|---|---|---|---|---|---|
| | | | | | | Ratio Treatment/Control | | | | |
| gi380848783 | Lectin precursor | Upregulated under *Aspergillus* infection | >2 | | | | | >2 | | |
| gi356555176 | Protein PAT1 homolog 1-like | Involved in plant-microbe interaction | | >2 | | | | | | |
| gi571467278 | Caffeoyl-CoA O-methyltransferase-like | Plant defense | | | | | | | | 1-2 |
| gi356535145 | Benzyl alcohol O-benzoyltransferase-like | Synthesis of anti-pathogen compounds | | | | | | 1-2 | | 1-2 |
| gi356554704 | UDP-glycosyltransferase 85A2-like | Synthesis of anti-pathogen compounds | >2 | | | | | | | |
| gi356539170 | Beta-adaptin-like protein C-like | Anti-fungal infection | >2 | | | | | | | |
| gi571470673 | Peroxisomal (S)-2-hydroxy-acid oxidase GLO1 | Plant disease resistance | >2 | | | | | 0.5-1 | >2 | |
| gi356495574 | Heat shock protein 90-1-like | Plant disease resistance | | | | | | 1-2 | | |
| gi571465187 | WD repeat-containing protein 74-like | *Rhizobium* induced cell growth | >2 | | | | | | | |
| gi356577969 | Isoflavone reductase-like | Nod gene induction | | | 1-2 | 1-2 | 1-2 | | 1-2 | 1-2 |
| gi571436840 | Pectinesterase/pectinesterase inhibitor 18-like | Plant defense | | | 1-2 | 1-2 | >2 | | | |
| gi356538839 | Allene oxide synthase, chloroplastic-like | Defense response to mechanical stress | | | 1-2 | 1-2 | 1-2 | | | 1-2 |
| gi356508869 | Lysosomal alpha-mannosidase-like | Bacterial colonization of lytic compartment | | | 1-2 | 1-2 | 1-2 | | | |
| gi356548301 | Phenylalanine ammonia-lyase class 2-like | Upregulation after wounding and infection | | | | | | 1-2 | 1-2 | 1-2 |

TABLE 18-continued

Proteins showing differential levels of expression under normal condition in endophyte-inoculated soybean seedlings relative to non-inoculated control seedlings.
ALTERED PROTEIN PRODUCTION IN RESPONSE TO INOCULATION WITH BACTERIAL SEED ENDOPHYTES

| ID | Protein | Function | | | | |
|---|---|---|---|---|---|---|
| gi\|358249162 | Uncharacterized protein LOC100780100 | Defense response to *Pseudocercospora* | | 1-2 | 1-2 | 1-2 |
| gi\|356553956 | Oxygen-evolving enhancer protein 2-2 | Defense response to bacteria | | 1-2 | | 1-2 |
| gi\|356568935 | Uncharacterized protein LOC100817481 | Nitrogen fixation | 1-2 | | | |
| gi\|356541838 | Methionine S-methyltransferase | Supports growth of *Corynebacterium* | | | 1-2 | 1-2 |
| gi\|571496006 | Gamma-glutamyl hydrolase | Symbiosis signal for *Bradyrhizobium* | | 1-2 | 1-2 | 1-2 |
| gi\|571460508 | Exosome complex exonuclease RRP44-like | Activated under conditional symbiosis | | | 0.5-1 | 0.5-1 |
| gi\|356556999 | Ubiquitin-NEDD8-like protein RUB1-like | Symbiosis: Auxin release | | | 1-2 | 1-2 |
| gi\|571472984 | ras GTPase-activating protein-binding protein | Possible symbiosis by G-protein binding | <0.5 | | | 1-2 |
| gi\|356554746 | H/ACA ribonucleoprotein complex subunit 4 | Symbiosis signal for *Bradyrhizobium* | 0.5-1 | | 0.5-1 | 0.5-1 |
| gi\|356508718 | Ras-group-related LRR protein 9-like | Cell to cell signalling | <0.5 | 0.5-1 | | |
| gi\|356565179 | Leghemoglobin reductase-like | Ferric leghemoglobin reduction | | | | 1-2 |

Growth Promotion

Proteins involved in the breakdown of seed stored reserves and playing important roles in the stimulation of continued growth during germination were up-regulated by endophytes. This class of proteins includes beta-fructofuranosidases, fructan 1-exohydrolases and carboxypeptidases involved in the mobilization of sucrose, fructans and insoluble proteins respectively, for the release of glucose, fructose and amino acids (Fincher 1989, Annu Rev. Plant Physiol. Plant Mol. Biol. 40:305-46). Those results show that bacterial endophytes induce a faster release of nutrients from the seed, leading to augmented growth at early stage of plant development. The levels of proteins playing a role in cell proliferation and elongation were also increased in endophyte-inoculated seedlings. This class of proteins includes dynamins, histones, a ribonucleoside-diphosphate reductase, pectinesterases and villins, involved in cell division, chromatin structure, DNA synthesis, cell wall remodeling and elongation respectively (Hepler et al. 2001, Annu Rev. Cell Dev. Biol. 17:159-87, Kang et al. 2003, The Plant Cell 15(4): 899-913, and Imoto et al. 2005, Plant Mol. Biol. 58:177-192). Those results demonstrate that, in response to the endophytic bacteria tested, the two types of plant growth, proliferation and elongation, are promoted, leading to substantial growth enhancement.

Resistance Against Stress

A number of proteins involved in resistance against stress were significantly up-regulated in wheat under stress induction and the presence of endophytes. The level of several proteins playing a role in resistance against oxidative stress by scavenging reactive oxygen species was higher in inoculated plants including glutathione S-transferases (GST), peroxidase and ascorbate oxidase (Apel and Hirt 2004, Annu Rev. Plant Biol. 55:373-99). Those results shows that in addition to plant growth, the endophytes tested promoted the general pathways involved in resistance against oxidative stress. The proteomics data-set also revealed the strong induction of a pectinesterase by SYM00011 and SYM00057B in wheat that might play a role in drought resistance as previously described (Mays et al. WO2013122473).

Symbiosis Enhancement

In maize under normal conditions, only GST was up-regulated, while other abscisic acid (ABA) and stress inducible proteins were down-regulated. The down-regulation of ABA and stress inducible proteins in maize was positively correlated with the down-regulation of proteins associated to programmed cell death, pathogen resistance and hypersensitive response. Moreover, the replication factor C, subunit 3 that negatively regulates plant defense was significantly overexpressed in the SYM00057b inoculated maize seedlings. Those results are consistent with the conventional wisdom that, under normal condition, the establishment of symbioses with beneficial microbes involves decrease in the expression of genes associated to the plant defense system (Samac and Graham, 2007, Plant Physiol. 144(2):582-587).

In addition, several proteins directly associated with beneficial symbioses are up-regulated in the wheat and maize. Several of these proteins are homologous to proteins involved in nodule formation in legumes. Many genes involved in nodulation, such as nodulation receptor kinases are broadly distributed in the plant kingdom, even in plants incapable of forming nodules, as is the case of maize (Endre et al. 2002, Nature 417:962-966). Some of these conserved receptors may sense bacterial signals in symbiotic associations other than Legume-*Rhizobia* and this may explain why the nodulation factors from *Badyrhizobium japonicum* are able to enhance seed germination and root growth in maize (Souleimanov et al. 2002, J. Exp. Bot. 53(396):1929-1934).

Results for Soybean Plants

In one embodiment, synthetic combinations of soybean plants and bacterial endophytes (e.g. SYM00057B, SYM00596, SYM00052, SYM00002, SYM00046, SYM00218, SYM00508 and SYM00940) grown under normal conditions produce a proteomic signature including polypeptides associated with growth promotion, resistance against stress and mechanisms involved in symbiosis enhancement (Table 18).

In particular, one or more pathways including the biosynthesis of proline, cell walls, methionine, carbohydrates, proteins, isoprenoid and flavonoids are modulated, e.g., at least one member (e.g., one, two, three, four, five, or six proteins) of a pathway such as arginase, xylose isomerase, sucrose synthase, 60S ribosomal protein L9, isopentenyl-diphosphate delta-isomerase II and flavonoid 3'-monooxygenase are increased relative to a reference soybean plant.

One or more proteins (e.g., one, two, three, four, five, six, seven, eight, nine, or ten proteins) that increase during seed filling, maturation and drying are also modulated, e.g., villin, beta-conglycinin, seed maturation proteins PM24 and PM30, Late embryogenesis abundant protein D-34, seed biotin-containing protein SBP65, embryonic protein DC-8-like, 35 kDa and 51 kDa seed maturation proteins and LEA protein precursor are decreased relative to a reference soybean plant.

One or more proteins (e.g., one, two, three, four, five, six, seven, eight, nine, or ten proteins) with demonstrated effects in plant defense or tolerance against biotic and abiotic stresses are modulated, e.g., 4-coumarate—CoA ligase, thioredoxin, gluthathione S-transferase, glutathione reductase, peroxidase, peroxisomal betaine-aldehyde dehydrogenase, lipoxygenase, heat shock protein 83-like, class I heat shock protein, and mitogen-activated protein kinase are increased relative to a reference soybean plant. In particular, proteins associated with drought tolerance, e.g., plastid-lipid-associated protein, ATP synthase subunit epsilon, chalcone-flavone isomerase, flavonoid 3'monooxygenase, aquaporin PIP2-1-like and prolyl endopeptidase-like are increased relative to a reference soybean plant.

One or more proteins (e.g., one, two, three, four, or five proteins) involved in stress response in the form of apoptosis, plant cell death or cellular degradation, e.g., programmed cell death protein 4, PR10-like protein, squamous cell carcinoma antigen, ubiquitin carboxyl-terminal hydrolase 24-like, and Ethylene-insensitive protein are decreased relative to a reference soybean plant.

One or more proteins (e.g., one, two, three, four, or five proteins) involved in the establishment of symbiosis with beneficial microbes and/or defense against pathogenic microbes, e.g., lectin, isoflavone-reductase-like, pectinesterase inhibitor 18-like, methionine S-methyltransferase and gamma-glutamyl hydrolase are increased relative to a reference soybean plant.

One or more proteins (e.g., one or two proteins) involved in symbiosis with root nodule forming microbes, a category different to the bacterial endophytes used in the experiment, e.g., H/ACA ribonucleoprotein complex and Leghemoglobin reductase-like, are decreased relative to a reference soybean plant.

Three proteins common to most synthetic combinations of soybean plants with endophytes that showed increased levels relative to a reference soybean plant are: alpha-L-fucosidase 2-like, chalcone-flavone isomerase and 26S protease regulatory subunit 7-like.

Three proteins common to most synthetic combinations of soybean plants with endophytes that showed decreased levels relative to a reference soybean plant are: seed biotin-containing protein SBP65, 35 kDa maturation protein and transketolase.

In another embodiment, proteins in the amino acid metabolism pathways such as aspartate aminotransferase glyoxysomal isozyme AAT1 precursor are increased relative to a reference soybean plant whereas glutamate synthase amyloplastic-like isoform X1 is decreased relative to the reference plant.

Example 8—Analysis of Hormone Levels in Inoculated Plants

As shown in some of the earlier examples, endophytic microbes described herein are capable of conferring significant beneficial traits on the inoculated agricultural plant. In order to explore the possibility that seed endophytes augment or modify hormone levels in planta, a metabolomic analysis was performed of 12 phytohormones (indole-3-carboxylic acid, trans-zeatin, abscisic acid, phaseic acid, indole-3-acetic acid, indole-3-butyric acid, indole-3-acrylic acid, jasmonic acid, jasmonic acid methyl ester, dihydrophaseic acid, gibberellin A3, salicylic acid) in wheat and maize plants grown on water agar under normal condition and inoculated by SYM00057B or a mix of selected endophytes (Table 19). The mixes of endophytes inoculums were obtained by mixing equal volume of the different bacterial cultures.

TABLE 19

Plant samples inoculated with seed bacteria used for hormone profiling.

| Crop | Treatment |
| --- | --- |
| Wheat (Briggs) | Formulation control |
| Wheat (Briggs) | SYM00057B |
| Wheat (Briggs) | Mix (SYM00011 + SYM00017C + SYM00049 + SYM00057B) |
| Maize (40R73) | Formulation control |
| Maize (40R73) | SYM00057B |
| Maize (40R73) | Mix (SYM00017C + SYM00049 + SYM00057B + SYM00188) |

Sample Preparation

Four-day old whole wheat and maize seedlings (including roots, seed and hypocotyl) were finely ground in liquid nitrogen by mortar and pestle then aliquoted into 1.5 mL microcentrifuge tubes and weighed. Phytohormones were extracted from ground sprouts using a protein precipitation protocol where cold extraction solvent (80% aqueous methanol with 1% acetic acid) containing internal standards was added to the finely ground plant material (40 Opt solvent for every 100 mg ground plant tissue). Samples were kept on ice during the addition of extraction solvent. Samples were then vortexed for 60 min at medium-high speed at 4° C., then centrifuged for 15 min at 13,000 g at 4° C. The resultant supernatant was removed and analyzed by LC-MS/MS.

LC-MS/MS

Phytohormones were chromatographically separated using a Waters nanoAcquity UPLC system on a Waters Atlantis dC18 column (3 μM, 300 μM×150 mm) held at 40° C. Samples were held at 4° C. in the auto-sampler. Water (buffer A) and acetonitrile (buffer B), both with 0.1% formic acid, were used as buffers. The flow rate was 11.5 μL min$^{-1}$ and injection volume 1 μL. Each sample was injected twice and hormone levels averaged. Phytohormones were analyzed by selected reaction monitoring (SRM) on a Waters Xevo TQ-S mass spectrometer in both negative and positive ion modes. The UPLC gradient was as follows: time (t)=0 min, 10% B; t=0.5 min, 10% B; t=5.5 min, 95% B; t=7.5 min, 95% B; t=8 min, 10% B. The column was equilibrated for three minutes before each injection.

Results

Inoculation of wheat and maize with seed endophytes significantly altered the level of several plant hormones, including indole-3-carboxylic acid, trans-zeatin, abscisic acid, phaseic acid and indole-3-acetic acid. In addition, the combination of multiple seed endosymbionts further modified the plant hormone profiling of inoculated plants. In particular, the level of abscisic acid and indole-3-carboxylic acid, the decarboxylated form of auxin, was augmented by 63% and 98% respectively in maize inoculated with the mixed endophytes.

Example 9—Greenhouse Assessment of Plant Response to Seed Bacterial Endophyte Populations A. Drought Stress Germination Assay Methods Several endophytes were tested in greenhouse experiments to assess their impact on seed germination and seedling growth enhancement under a variety of watering regimes. Non-sterile wheat seeds (Briggs or Prosper) were coated using the formulation described below for bacterial field trials. Trays were prepared with sifted top soil (Fafard) and watered approximately 2-4 hours prior to planting seeds. Three watering regimes were tested to observe growth effects under drought (2 L), normal (3 L), or saturated (4 L) conditions. Irrespective of initial water volume, no further watering was performed for the duration of the experiments. For each bacterial treatment eight replicate plots of 12 seeds were planted in a single tray. Starting on the third day post planting, germination was scored for each of the eight plots until the seventh day, at which point the seedlings were harvested, bagged, and dried prior to dry aboveground biomass assessment for each replicate.

Results

Twenty-six individual isolates were examined for growth enhancement under a normal watering regime in greenhouse experiments. A subset consisting of 20 of the 26 isolates was also tested in dry and saturated conditions in order to assess the microbial effects on seedling vigor and germination when seeds were subjected to these types of water stress. Significant emergence increases were only measurable on the first day of emergence scoring as on subsequent days most treatments were able to catch the earliest emerging treatments. Of note, 75% of bacteria-treated seeds displayed an increase in early emergence under drought stress and 40% of treatments stimulated increased early emergence in the flood regime. By contrast only 27% of treatments induced increased emergence under normal conditions (Table 20). Despite the caveat that different cultivars of wheat were tested under either normal or drought v. saturated conditions, there may be an increased chance of observable effects when seedlings are exposed to a stressful environment during germination.

TABLE 20

Wheat germination and early emergence assessment in response to drought stress.

| | | Wheat seedling responses to drought conditions in greenhouse | | | |
|---|---|---|---|---|---|
| | | Germination D 1 | | | Dry shoot weight |
| SYM # | OTU | Prosper D | Briggs N | Prosper S | Briggs N |
| SYM00033 | 0 | — | — | 3 | — |
| SYM00284 | 0 | — | — | — | — |
| SYM00660 | 1 | 2 | — | 3 | — |
| SYM00011 | 2 | 3 | — | — | — |
| SYM00167 | 3 | 3 | — | 3 | 1 |
| SYM00188 | 6 | — | — | — | 1 |
| SYM00292 | 6 | — | — | — | — |
| SYM00049 | 7 | 3 | — | — | — |
| SYM00596 | 9 | 2 | — | — | — |
| SYM00595 | 12 | — | — | — | — |
| SYM00028 | 18 | 3 | 1 | — | — |
| SYM00192 | 19 | 3 | 2 | 3 | 1 |
| SYM00260 | 19 | — | 1 | 3 | 1 |
| SYM00016b | 25 | 3 | 3 | 2 | 2 |
| SYM00021 | 29 | — | — | — | — |
| SYM00775 | 30 | — | — | — | — |
| SYM00057b | 37 | 3 | — | — | — |
| SYM00075 | 39 | — | 3 | — | — |
| SYM00218 | 41 | — | 1 | — | — |
| SYM00017c | 45 | 3 | 2 | 3 | — |
| SYM00168 | 45 | 3 | — | — | — |
| SYM00231 | 46 | 3 | — | — | — |
| SYM00012 | 55 | — | — | — | 1 |
| SYM00046 | 56 | — | — | — | — |
| SYM00107 | 59 | 3 | — | 3 | 1 |
| SYM00254 | 59 | — | — | — | — |
| SYM00090 | 62 | — | — | — | — |
| SYM00002 | 66 | 3 | 3 | — | — |
| SYM00071 | 76 | 3 | — | — | — |
| SYM00290 | 154 | — | — | — | — |
| SYM00508 | 196 | — | — | 3 | — |

Legend:
"—" indicates no significant increase relative to non-inoculated control;
"1" = 0-5% increase relative to non-inoculated control;
"2" = 5-10% increase relative to non-inoculated control;
"3" = >10% increase relative to non-inoculated control.
Conditions; D = drought, N = normal, S = saturated.

C. Seedling Growth Assay in Magenta Boxes

Representative endophytes isolated from seeds as described herein were tested for their ability to promote plant growth under normal conditions by inoculating barley (cv. Conlon) seedlings with those endophytes and growing them in a greenhouse on double-decker Magenta boxes essentially as described by Rodriguez and colleagues (2008). Briefly, the double-deckers were made by drilling a hole 8 mm in diameter in the center of a GA-7 plant culture vessel (Magenta boxes, Sigma, St. Louis), top-knotting and weaving through a 14 cm length of cotton rope to the bottom chamber to act as a wick and filling the upper chamber with playground sand (350 g, approximately). Peter's 20-20-20 plant nutrient solution (Peters Fertilizer Co., Fogelsville, Pa.) is added to the bottom chamber and a tight-fitting lid is added to the top and the whole system autoclaved and sterilized prior to planting with non-inoculated or endophyte-treated seedlings.

Barley seeds were surface sterilized with chlorine gas as described herein. Sterilized maize seeds were germinated on sterile vermiculite. Four day old seedlings were inoculated hydroponically in scintillation vials with the appropriate bacterial suspensions (0.2-0.4 optical density at 600 nm). The suspensions were prepared by pelleting 300 ml cultures of the bacteria grown overnight in R2 broth at 600 G for 20 min. The pellets were re-suspended in 20 mM Phosphate Buffer pH 7.0. Non-inoculated controls were incubated hydroponically on sterile Phosphate Buffer. Up to three seeds were planted on each double-decker Magenta box and two boxes were used per treatment (endophytic bacteria or control). The double-deckers were maintained for four days in a greenhouse set for 14 hours of light (400 mE×m$^{-2}$×s$^{-1}$ minimum) and 10 h of darkness. On the fifth day after planting in the boxes, the plants were harvested, photographed and dried in a convection oven at 45° C. to estimate dried biomass. Shoot and root lengths were measured digitally using the software ImageJ version 1.48u4 (Rasband imagej.nih.gov).

Figure 11A:
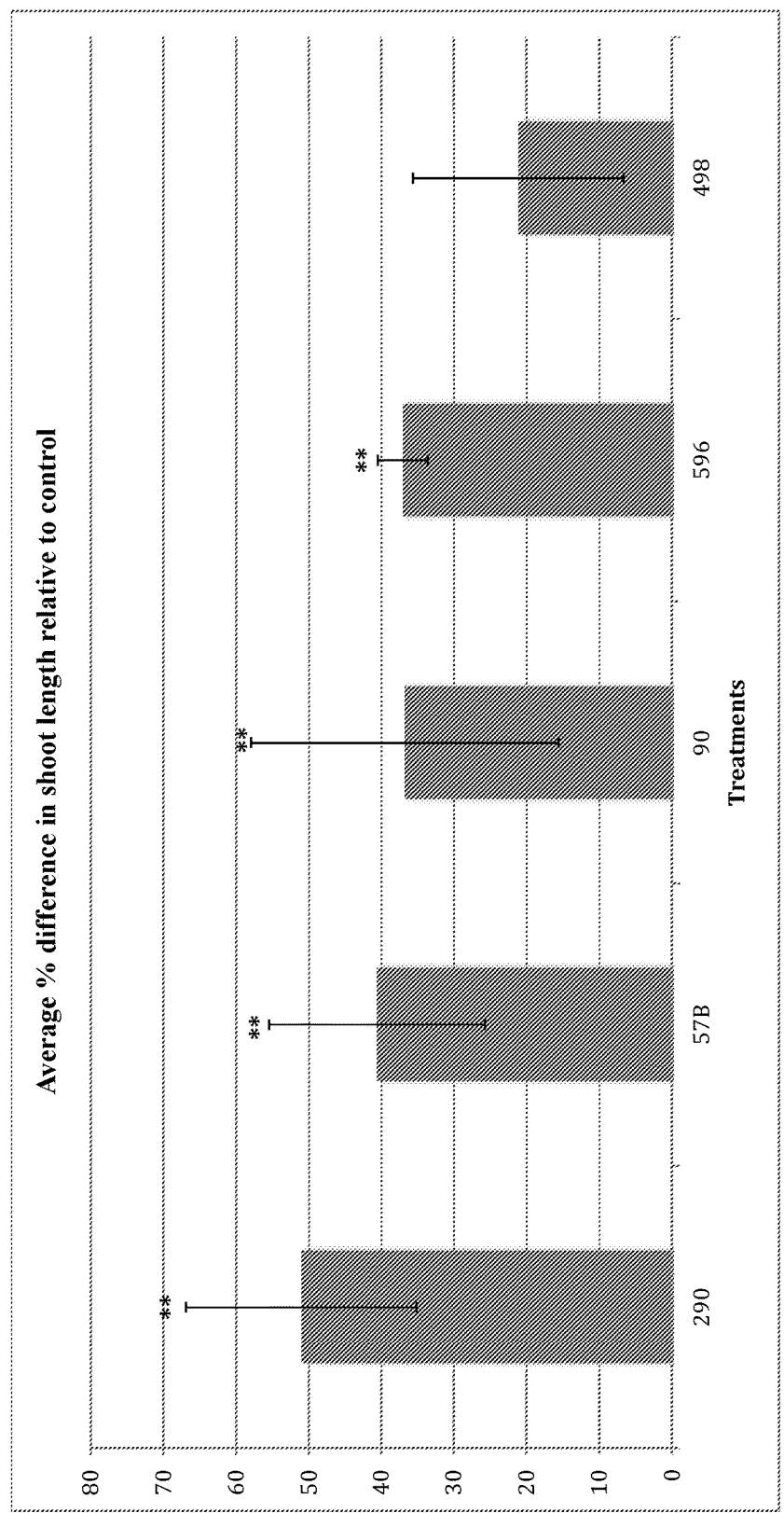
FIG. 11A is a graph depicting the average percentage difference in seedling shoot length of barley (cultivar Conlon) plants inoculated with seed endophytes SYM00290, SYM00057B, SYM00090, SYM00596, or SYM00498 and grown in Magenta boxes relative to non-inoculated controls. Bars indicate standard deviation. * $p<0.05$, ** $p<0.01$.
Figure 11B:
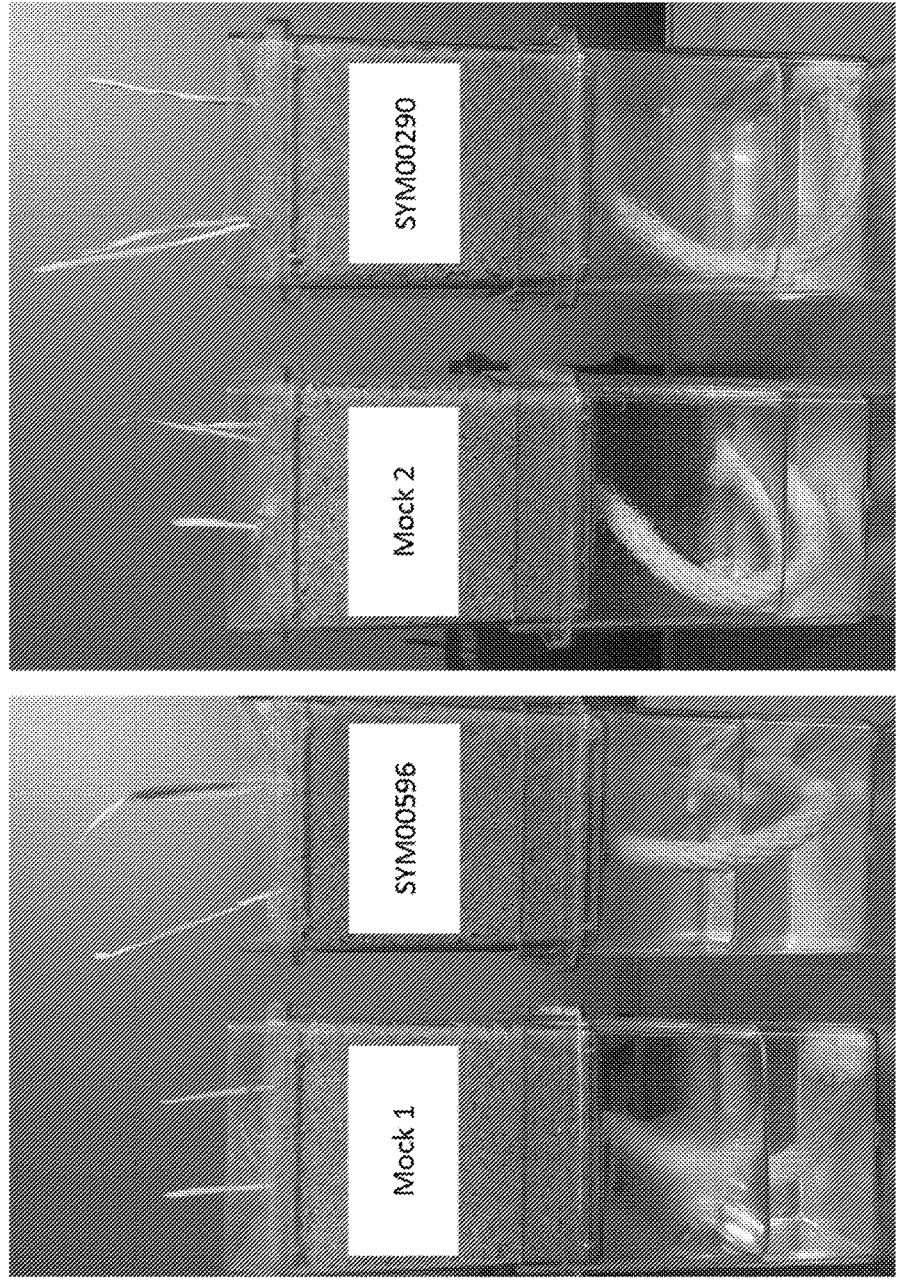
FIG. 11B is a photograph of representative examples of barley seedlings (cultivar Conlon) mock inoculated (control) and inoculated with seed bacterial endophytes SYM00596 or SYM00290 and grown in magenta boxes under normal conditions in the greenhouse. The shoots of the inoculated plant are not only larger but also greener.

The effect of the endophyte inoculation on shoot length was tested using in comparison against non-inoculated controls using one-way Analysis of Variance, followed up by a Dunnett (two-sided) test to identify the particular treatments that were significantly different compared to the controls. The results obtained for individual endophytes are summarized in FIG. 11a and for combos in Table 21. All individual isolates and combinations tested provided growth improvement relative to the non-inoculated control plants under normal conditions, mainly in the form of increased shoot length. These differences relative to the control plants were statistically significant for all treatments except SYM00498 that nevertheless showed a trend of improvement (FIG. 11a).

TABLE 21

Summary of results of testing synthetic combinations of seed endophytes on barley (cv. Conlon) in Magenta boxes in the greenhouse.

| Barley (cv. Conlon) in magenta boxes | | | Shoot length | |
|---|---|---|---|---|
| SYM #1 | SYM #2 | OTU | Score | % Difference relative to control |
| SYM00596 | SYM00090 | 7 + 3 | 3 | 33.36 |
| SYM0057b | SYM00090 | 37 + 3 | 3 | 43.09 |

Legend:
"—" indicates no significant increase relative to non-inoculated control;
"1" = 0-5% increase relative to non-inoculated control;
"2" = 5-10% increase relative to non-inoculated control;
"3" = >10% increase relative to non-inoculated control.

Example 10—Field Trial Planting & Assessment of Plant Health Under Stress

Planting & Setup of Field Trials in Normal and Stressed Conditions

To determine whether a microbe or combination of microbes is capable of promoting plant growth in the field, a field trial was conducted using representative endophytic microbes described herein. The trial involved testing individual bacterial isolates and combinations of isolates by treating and planting the seeds of organic maize seeds (Blue River hybrids, 39A16) and wheat seeds (Prosper, developed by South Dakota State University). For preparation of inoculum, lawns of bacteria were grown for 48 hours on solid Petri dishes of half strength TSA (trypticase soy agar), scraped off and resuspended to an OD600=50 in sterile 20 mM sodium phosphate buffer containing 1% sodium alginate and 3% sucrose at a pH of 7. For wheat seed treatment, 32.5 mL of this bacterial suspension plus 1.5 mL of plantability polymer Flo Rite 1706 were injected into a Hege 11 seed treater (Wintersteiger Inc, Austria) evenly coating 2 kg of seed with bacterial suspensions. For maize seed treatment, 10 mL of this bacterial suspension plus 0.5 mL of plantability polymer Flo Rite 1706 was injected into a Hege 11 seed treater (Wintersteiger Inc, Austria) evenly coating 0.6 kg of seed with bacteria. To ensure seed inoculants had survived at significant levels at the time of planting, 4 seeds per treatment that had passed through the planter were collected and surface bacteria extracted using bead beating in a Fastprep24 machine with carbide beads and 1 mL of R2A broth in a 15 mL Falcon tube shaking at 6 M s$^{-1}$ for 60 seconds. These extracts were serially diluted by factors of 1 to $10^{-9}$ and 10 ul drops plated onto R2A Petri dishes to allow colony counting. At the time of planting, all seed tested in all bacterial treatments were found to have at least 100,000 CFU on the surface (data not shown).

A typical trial was laid out as a randomized complete block design, with each combination of microbial treatment (s) and plant variety replicated six times (once per block). Field trials were planned and planted in partnership with the field research services branch of SGS North America Inc. Trials were conducted across various geographies including field sites in major producing regions of South Dakota (Brookings), Illinois (Wyoming), and Austria (Tulln and Groβ-Enzersdorf), on both dry and irrigated land to test responses in both well-watered and drought-stressed conditions. Fertilizer and herbicides were applied according to soil test results and SGS Field Research Services recommended practice.

For maize, typical field plots were 10'×40' with 4 evenly spaced rows, seeded at a rate of approximately 34,000 seeds per acre. Each randomized complete block trial included an untreated control treatment and a bacteria-free formulation only control, as well as additional untreated border plots. In Brookings, S. Dak., seeds of genotype 39A16 from Blue River Organics were treated with bacterial isolates SYM00016, SYM00028, SYM00039, SYM00049, SYM00057b, SYM00063b, SYM00064a, SYM00072, SYM00074 and planted. In Wyoming, Ill., seeds of genotype 39A16 from Blue River Organics were treated with bacteria SYM00011, SYM00090, SYM00102, SYM00167, SYM00595, SYM00596, SYM00975, and combinations; SYM00090+SYM00011, SYM00090+SYM00102, and SYM00090+SYM00596, and planted. In Tulln and Groß Enzersdorf, Austria, seeds of maize varieties Chapalu, Futurixx, ES Palazzo, and DieSamba were treated with bacteria SYM00254, SYM00260, SYM00284, or SYM00292 and planted.

For wheat, typical field plots were 5'×50' with 7 evenly spaced rows, seeded at a rate of approximately 90 lbs per acre. Each randomized complete block trial included an untreated control treatment and a bacteria-free formulation only control. Seeds of the hard red spring wheat variety, "Prosper" (South Dakota Seed) were treated with SYM00016, SYM00064, SYM00072, or bacteria free formulation, then planted at an SGS field in Brookings, S. Dak. Measurement of Emergence & Plant Height Emergence in the field plots was assessed for wheat by counting the number of emerged plants in the middle 10' section of the middle two rows and reporting the total number plants emerged per plot. Emergence counts were taken every four days starting with the day of emergence of the first plants and ending when 50% or more of the plants in the plot had reached Feekes scale 2. Emergence in the field was assessed for maize by taking a full count of all emerged plants in the plot and reporting the number of emerged plants as a percentage of the number of seeds planted in that plot. Two emergence counts were taken, one at the emergence of the first plants and a second count five days later.

Emergence of wheat and maize in 2014 field trials is shown in Table 22. All SYM endophytes showed improvement in percent early seedling emergence over the formulation only control, with SYM00016 and SYM00072 showing the greatest improvement. Emergence of maize in a field trial is shown in Table 22b and 22c. The percentage improvement in early emergence was based on an average of emergence counts of 6 replicate plots for each treatment over a 4 day period. All SYM isolates and binaries showed improvement in early emergence over the formulation only control, except for SYM00016, SYM00102, SYM00254, SYM00260 and SYM00284. For wheat, treatment with roughly half of the bacterial isolates resulted in at least a one day shift in flowering time demonstrating impacts on later developmental stages of the plant. Plant height and yield data were not yet available at the time of writing.

Table 22.

Summary of the effects of wheat (A) or maize (B) seed inoculation with endophytic bacteria extracted from seeds of rice or maize on early emergence and flowering time in the field. The largest effects observed for each endophyte and seed variety combination are reported here. Legend: "–" indicates no significant increase relative to non-inoculated control; "1"=0-5% increase relative to non-inoculated control; "2"=5-10% increase relative to non-inoculated control; "3"=>10% increase relative to non-inoculated control.

TABLE 22(a)

Field assessment of early emergence and flowering time in wheat.

| SYM # | OTU | Increased early wheat emergence | Altered wheat flowering time |
|---|---|---|---|
| SYM00284 | 0 | 2 | 1 |
| SYM00292 | 6 | 2 | 1 |
| SYM00064 | 10 | 1 | — |
| SYM00260 | 19 | 3 | — |
| SYM00016 | 25 | 3 | 1 |
| SYM00072 | 39 | 3 | 1 |
| SYM00254 | 59 | 1 | — |

TABLE 22(b)

Field assessment of early emergence in maize for seeds treated with individual seed endophytes.

| SYM # | OTU | Increased early maize emergence |
|---|---|---|
| SYM00284 | 0 | — |
| SYM00011 | 2 | 3 |
| SYM00167 | 3 | 3 |
| SYM00292 | 6 | 2 |
| SYM00049 | 7 | 1 |
| SYM00596 | 9 | 3 |
| SYM00064 | 10 | 1 |
| SYM005951 | 12 | 3 |
| SYM00028 | 18 | 2 |
| SYM00260 | 19 | — |
| SYM00016 | 25 | — |
| SYM00057b | 37 | 1 |
| SYM00102 | 38 | — |
| SYM00072 | 39 | 1 |
| SYM00975 | 51 | 3 |
| SYM00254 | 59 | — |
| SYM00090 | 62 | 3 |

TABLE 22(c)

Field assessment of early emergence in maize for seeds treated with combinations of seed endophytes.

| SYM #1 | SYM #2 | OTU | Increased early maize emergence |
|---|---|---|---|
| SYM00090 | SYM00011 | 62 + 2 | 2 |
| SYM00090 | SYM00102 | 62 + 38 | 3 |
| SYM00090 | SYM00596 | 62 + 9 | 3 |

Measurement of Flowering Time

The day of flowering for a particular plot is recorded when 50% or more of the plants in the plot have reached the flowering stage.

SPAD Measurement

Chlorophyll values, for example, SPAD readings are conducted on wheat by measuring 10 plants per plot at random from the middle two rows. The first measurement is done at flowering, with a second measurement done two weeks later on the same 10 plants in each plot. The SPAD reading is taken on the flag leaf on each plant, for example, as measured with SPAD502 supplied by Minolta Co., Ltd., at approximately three quarters of the leaf length from the leaf base and avoiding the midrib of the leaf SPAD readings are conducted on maize by measuring 10 plants per plot at random from the middle two rows. The first measurement is done at flowering (VT stage), with a second measurement done two weeks later on the same 10 plants in each plot. The SPAD reading is taken on the topmost leaf under the tassel, approximately 0.5 inch from the edge of the leaf and three quarters of the leaf length from the leaf base.

Stand Count & Lodging Assessment

Stand count and percent lodging are assessed in wheat by counting the total number of tillers and the number of broken stalks in the middle two rows on the day of harvest. Stand count and percent lodging are assessed in maize by counting the number of standing plants and the number of stalks broken below the ear in the middle two rows on the day of harvest.

Measurement of Biomass

Biomass of field plots is assessed by selecting 10 plants per plot for maize or 20 plants per plot for wheat at random from the middle two rows at harvest, removing the plants from the soil and cleaning off any residual soil. Plants are then divided into aerial and root sections and weighed to obtain fresh weight. Plants are then be dried in a vacuum oven overnight and weighed again to obtain dry weight.

Measurement of Yield, Grain Moisture, Test Weight

Yield of field plots is measured at the end of the growing season by harvesting the plots with an appropriate harvester. For maize, only the middle two rows are harvested. For wheat, all 7 rows may be harvested, or only the middle 5 may be used. Test weight and moisture of the grain may be recorded by the harvester, or subsamples of the harvested grain may be used for manual test weight assessment and moisture analysis in a DICKEY-john® grain moisture analyzer (Dickey-John Corp., Chatham, Ill.), using parameters recommended by the manufacturer.

Sterilization of Seed Surfaces from Microorganisms Using Disinfecting Chemicals

Example Description

In order to isolate and characterize endophytic microorganisms, all microorganisms living on the surface of the plant, plant tissue, or plant structure must be removed. After a pre-wash to remove all loosely attached microorganisms, the surfaces are sterilized with disinfecting chemicals, and the plant tissue is tested for sterility.

Description of Methods

Surface sterilization of seeds is performed as described by Bacon and Hinton (2007, Manual of Environmental Microbiology, 3rd Edition HURST et al. Eds. (2007): 638-647 with some modifications ( ). Briefly, batches of seeds are first prewashed to remove as many of the surface bacteria as possible by vigorously washing them in sterile 0.05 M phosphate buffer (pH 7.2). If the seeds have been treated with pesticides, the prewash buffer contains 0.01% Tween 20 or 0.05% Triton X-100, and is followed by 3-5 washes in 75-90% ethanol. They then are allowed to imbibe in 1× sterile phosphate-buffered saline (PBS) at 4° C. for 24 h (or different times depending on the seed variety). After imbibing, they are surface sterilized by immersion in 70% ethanol for 5 min, 10% bleach solution for 3-15 minutes (depending on seed), and rinsed twice with autoclaved distilled water. Alternatively, samples can be surface-sterilized by using 1% chloramine or 1% sodium hypochlorite for 3 minutes followed by 70% ethanol for 5 minute and rinsed twice with sterile distilled water. Alternatively, seeds can be sterilized by submerging them in 10% hydrogen peroxide for 5 min-1 hour and then rinsed twice with sterile distilled water. Samples are blotted dry using autoclaved paper towels. Once sterilized, a few seeds of each batch are aseptically imprinted onto Tryptic Soy Agar (TSA) and Potato Dextrose agar (PDA) in a Petri dish using sterile forceps: one of the sides of the seed is pressed first, then the seed is turned onto its other side on another part of the plate, and then removed. These plates are stored in the dark for five days and checked daily for bacterial and/or fungal growth. If the batch of seeds proves to retain microbes, the whole batch is destroyed and the experiment re-started with new seeds.

Other plant tissues are surface-sterilized and tested for sterility essentially as described for seeds, with some modifications:

1. Leaves: Leaves are detached and pre-washed as described for seeds. Then they are placed in 1% chloramine or 1% sodium hyperchlorite for 30 minutes, or in full strength commercial bleach for 5 minutes, and washed twice in 3-5 times in distilled sterile water for 3 minutes. Samples are blotted dry using autoclaved paper towels. 5 grams of leaf tissue are then transferred to a sterile blender and processed as described for seeds with 50 mL of R2A broth.
2. Roots: Roots are removed from the plants and pre-washed twice as described for seeds to remove all attached soil. Roots are surface-sterilized in 1% chloramine or 1% sodium hypochlorite solution for up to 30 minutes (or alternatively 10% bleach) and washed 3-5 times in distilled sterile water for 3 minutes. The roots are then immersed for 30 minutes in sterile 0.05 M phosphate buffer (pH 7.2) and then rinsed several times. Five g of root tissue are then transferred to a sterile blender and processed as described for seeds with 50 mL of R2A broth.
3. Stems: A portion of the plant stem is cut from the plant pre-washed as described for seeds. It is then surface sterilized as described for the roots and washed twice in distilled sterile water for 3 minutes. Five g from the inside of the stem are removed by cutting the outside layer with a sterile blade and processed as described for seeds.

Sterilization of Seed or Plant Surface from Bacteria Using Antibiotic Agents

Seeds are surface sterilized with antibacterial compounds such as sodium hypochlorite, copper oxychloride, copper hydroxide, copper sulfate, chlorothalonil, cuprous oxide, streptomycin, copper ammonium carbonate, copper diammonia diacetate complex, copper octanoate, oxytetracycline, fosetyl-AL or chloropicrin. Seed is soaked in an aqueous solution or commercial formulation containing one or more of these compounds for 30 seconds to 12 hours in a plastic container. The solution may also be administered to seedlings or plants by spraying or soaking leaves or other aerial parts of the plant, after which the plant tissues are sprayed or rinsed with water to remove residual fungicide. After surface sterilization, the seed is removed from the antibacterial formulation and washed 3-5 times with sterile distilled water.

Sterilization of Seed or Plant Surface from Fungi Using Fungicidal Agents

Seeds are surface sterilized by use of contact fungicides such as captan, maneb, thiram, fludioxonil, or others. Seed is soaked in an aqueous solution or commercial formulation containing one or more of these compounds for 30 seconds to 12 hours in a plastic container. After surface sterilization, the seed is removed from the fungicide solution and washed 3-5 times with sterile distilled water. The solution of fungicides may also be administered to seedlings or plants by spraying or soaking leaves or other aerial parts of the plant, after which the plant tissues are sprayed or rinsed with water to remove residual fungicide. Systemic fungicides such as azoxystrobin, carboxin, mefenoxam, metalaxyl, thiabendazole, trifloxystrobin, difenoconazole, ipconazole, tebuconazole or triticonazole may also be used only when it is desirable to also sterilize interior tissues.

Isolation of Bacteria and Fungi from the Interior of Seeds
Example Description

Isolation of fungi and bacteria (including endophytes) from the interior of surface-sterilized seeds is done using techniques known in the art. Surface sterilized seeds are ground, diluted in liquid media, and this suspension is used to inoculate solid media plates. These are incubated under different conditions at room temperature.

Experiment Description

Approximately fifty surface-sterilized seeds are transferred aseptically to a sterile blender and ground. The ground seeds are resuspended in 50 mL of sterile R2A broth, and incubated for 4 h at room temperature. Ten 1 mL aliquots of the seed homogenates are collected and centrifuged, their supernatants discarded and the pellets gently resuspended in 1 mL of sterile 0.05 phosphate buffer; 0.5 mL of 50% glycerol is added to each of five tubes. These are stored at $-80°$ C. for possible further characterization (i.e. if the plates become too overcrowded with one microorganism, the frozen aliquots can be used to plate lower dilutions of the homogenate). The remaining aliquots are diluted down twice in hundred-fold dilutions to $10^{-4}$. 100 microliters of the 1, $10^{-2}$, and $10^{-4}$ dilutions are used to inoculate three Petri dishes containing the following media in order to isolate of bacteria and/or fungi:
 1. Tryptic Soy agar
 2. R2A agar
 3. Potato dextrose agar
 4. Sabouraud Agar
 5. Other media depending on target microorganism The plates are divided into three sets including each media type and incubated in different environments. The first set is incubated aerobically, the second under anaerobic conditions, and the third under microaerophilic conditions and all are inspected daily for up to 5 days. One to two individual colonies per morphotype are isolated and streaked for purity onto fresh plates of the same media/environment from which the microorganism was isolated. Plates are incubated at room temperature for 2-5 days. Once an isolate grows it is streaked once more for purity onto a fresh plate of the same media to ensure purity and incubated under the same environmental conditions.

From the second streaked plate, isolates are stored in Tryptic soy broth +15% glycerol at $-80°$ C. for further characterization, by first scraping 2-3 colonies (about 10 µL) from the plate into a cryogenic tube containing 1.5 mL of the above-mentioned media and gently resuspending the cells. Alternatively, isolates are propagated in specialized media as recommended for the particular taxon of microorganism. The microbes obtained represent those that live in the seeds of the plant accession.

Isolation of Bacteria and Fungi from Plant Interior Tissues
Example Description

Isolation of fungi and bacteria (including endophytes) from surface-sterilized plant tissues is done using techniques known in the art. Surface sterilized plant tissues are ground, diluted in liquid media, and then this suspension is used to inoculate solid media plates. These are incubated under different environmental conditions at room temperature.

Experiment Description

Approximately fifty grams of surface-sterilized plant tissue are transferred aseptically to a sterile blender and ground. The ground tissue is resuspended in 50 mL of sterile R2A broth, and incubated for 4 h at room temperature. Ten 1 mL aliquots of the plant tissue homogenates are collected and centrifuged, their supernatants discarded and the pellets gently resuspended in 1 mL of sterile 0.05 phosphate buffer. Glycerol (0.5 mL of 50%) is added to each of five tubes. These are stored at $-80°$ C. for possible further characterization (i.e. if the plates become too overcrowded with one microorganism, the frozen aliquots can be used to plate lower dilutions of the homogenate). The remaining aliquots are diluted down twice in hundred-fold dilutions to 10'. One hundred microliters of the 1, $10^{-2}$, and 10-4 dilutions are used to inoculate three Petri dishes containing the following media in order to isolate of bacteria and/or fungi:
 1. Tryptic Soy agar
 2. R2A agar
 3. Potato dextrose agar
 4. Sabouraud Agar
 5. Other media depending on target microorganism Plates are divided into three sets including each media type and incubated in different environments. The first set is incubated aerobically, the second under anaerobic conditions, and the third under microaerophilic conditions and all are inspected daily for up to 5 days. 1-2 individual colonies per morphotype are isolated and streaked for purity onto fresh plates of the same media/environment from which the microorganism was isolated. Plates are incubated at room temperature for 2-5 days. Once an isolate grows it is streaked once more for purity onto a fresh plate of the same media to ensure purity and incubated under the same environmental conditions.

From the second streaked plate, isolates are stored in Tryptic soy broth +15% glycerol at $-80°$ C. for further characterization, by first scraping 2-3 colonies (about 10 µL) from the plate into a cryogenic tube containing 1.5 mL of the above-mentioned media and gently resuspending the cells. Alternatively, isolates are propagated in specialized media as recommended for the particular taxon of microorganism. The catalog of microbes thus isolated constitutes a good representation of the microbes found in the growing plant tissues.

Isolation of Bacteria and Fungi from Plant or Seed Surfaces

To collect phyllosphere, rhizosphere, or spermosphere material for culturing of microbes, unwashed shoot, roots or seeds are shaken free/cleaned of any attached soil and stuffed into sterile 50 mL Falcon tubes. To these, 10 mL of sterile 0.1 M sodium phosphate buffer is added and shaken, followed by 5 minutes of sonication to dislodge microbes from plant surfaces, with the resulting cloudy or muddy wash collected in a separate 15 mL Falcon tube. 100 µL of this microbe filled wash can be directly spread onto agar plates or nutrient broth for culturing and enrichment, or it can be further diluted with sterile 0.1 M sodium phosphate buffer by 10×, 100×, 1,000×, 10,000× and even 100,000×, before microbial culturing on agar plates or nutrient broth. Glycerol stock preparations of the plant surface wash solution should be made at this point by mixing 1 mL of the soil wash solution and 0.5 mL of sterile, 80% glycerol, flash freezing the preparation in a cryotube dipped in liquid nitrogen, and storing at −80° C. Nutrient broth inoculated with a mixture of plant surface bacteria should form a stable, mixed community of microbes which can be used in plant inoculation experiments described herein, subcultured in subsequent broth incubations, or spread on agar plates and separated into individual colonies which can be tested via methods described herein.

Characterization of Fungal and Bacterial Isolates
Example Description

Characterization of fungi and bacteria isolated from surface-sterilized or non-sterilized plant or seed tissues is done using techniques known in the art. These techniques take advantage of differential staining of microorganisms, morphological characteristics of cells, spores, or colonies, biochemical reactions that provide differential characterization, and DNA amplification and sequencing of diagnostic regions of genes, among other methods.

Description of Methods

Isolates of bacteria and/or fungi isolated as described herein (including endophytic bacteria and fungi) are categorized into three types: bacterial isolates, fungal isolates, and unknown isolates (since yeast colonies can resemble bacterial colonies in some cases) based on colony morphology, formation of visible mycelia, and/or formation of spores. To determine if an unknown isolate is bacterial or fungal, microscopic analysis of the isolates is performed. Some of the analyses known to the art to differentiate microorganisms include the 10% KOH test, positive staining with Lactophenol cotton blue, Gram staining, and growth on media with selective agents. The distinguishing features observed by these tests are relative cell size (yeast size is much larger than bacterial size), formation of hyphae and spores (filamentous bacteria form smaller hyphae than fungi, and do not form structures containing spores), or growth under selection agents (most bacteria can grow in the presence of antifungal compounds like nystatin, while most fungi cannot; likewise, most fungi are unaffected by the presence of broad-spectrum antibiotics like chloramphenicol and spectinomycin).

To identify the isolates, DNA sequence analysis of conserved genomic regions like the ribosomal DNA loci is performed. To obtain DNA to perform PCR amplifications, some cellular growth from solid media (approximately 5-10 µL) is resuspended in 30 µL of sterile Tris/EDTA buffer (pH 8.0). Samples are heated to 98° C. for 10 minutes followed by cooling down to 4° C. for 1 minute in a thermocycler. This cycle is repeated twice. Samples are then centrifuged at ~13,000 RCF for 1-5 minutes and used as DNA template for PCR reactions. Below is a series of primer combinations that can be used to identify isolates to a genus level (Table 23).

TABLE 23

Primer pairs used for taxonomic identification of bacterial and fungal isolates and their targeted regions.

| Primer 1 | Primer 2 | Reference |
|---|---|---|
| V4_515F (5'-GTGCCAGCMGC CGCGGTAA-3') | V4_806R (5'-GGACTACHVG GGTWTCTAAT-3') | |
| Target | The 4$^{th}$ Variable region of the bacterial 16S rDNA | (Caporaso et al. 2012) |
| 27F (5'-AGAGTTTGATC CTGGCTCAG-3') | 1492R (5'-GGTTACCTTG TTACGACTT-3') | |
| Target | Full length of the bacterial 16S rDNA, from position 8-1507. | |
| ITS1 (5'-TCCGTAGGTGA ACCTGCGG-3') | ITS2 (5'-GCTGCGTTCT TCATCGATGC-3') | |
| Target | ~240 bp ITS1 region of fungal genome | |
| SR1R (5'-TACCTGGTTGA TQCTGCCAGT-3') | SR6 (5'-TGTTACGACT TTTACTT-3') | |
| Target | Small subunit (18s) of the fungal rDNA gene | |
| ITS1F (5'-CTTGGTCATTT AGAGGAAGTAA-3') | ITS4 (5'-TCCTCCGCTT ATTGATATGC-3') | |
| Target | ~600-1000 bp ITS region of fungal genomes | (Manter & Vivanco 2007, J Microbiol Methods 71(1):1-14) |

To decrease background noise due to the non-specific binding of primers to DNA, the thermocycler is programmed for a touchdown-PCR, which increases specificity of the reaction at higher temperatures and increases the efficiency towards the end by lowering the annealing temperature. Below is an example of the conditions for a typical Touchdown PCR (Table 24).

TABLE 24

Example conditions for touchdown PCR

| Step # | Cycle | Temperature | Time |
|---|---|---|---|
| 1 | Initial Denaturalization | 98° C.* | 5 m |
| 2 | Denaturalization | 98° C.* | 30 s |
| 3 | Annealing | Predicted optimal Tm for the primer set + 10° C., minus 1° C./cycle | 30 s |
| 4 | Elongation | 72° C.* | 1 m/1 kb |
| 5 | GoTo Step 2 × 10 times | | |
| 6 | Denaturalization | 98° C.* | 30 s |
| 7 | Annealing | Predicted optimal Tm for the primer set | 30 s |
| 8 | Elongation | 72° C.* | 1 m/1 kb |

TABLE 24-continued

Example conditions for touchdown PCR

| Step # | Cycle | Temperature | Time |
|---|---|---|---|
| 9 | GoTo Step 6 × 20 times | | |
| 10 | Final Elongation | 72° C.* | 5 m |
| 11 | Cool Down | 4° C. | 5 m |

*Or the temperature specified by the DNA polymerase manufacturer for this step.

PCR reactions are purified to remove primers, dNTPs, and other components by methods known in the art, for example by the use of commercially available PCR clean-up kits, or 3M sodium acetate and chilled absolute ethanol as described below:

1. For each 20 μL of PCR product, the following mixture is prepared and maintained cool in a 1.5 mL Tube.
   2 μL of 3 M sodium acetate (NaOAc) pH 4.5
   40 μL chilled absolute ethanol.
2. Transfer the PCR product (20 μl) into the tube containing the mixture.
3. Vortex the tube and then store it at −20 for 30-50 min.
4. Spin for 30 min at maximum speed 14.000 rpm.
5. Remove the supernatant carefully without disturbing the pellet. (Do not touch the bottom of the tube)
6. Wash the pellet with 100 μl of chilled 70% ethanol and centrifuge at ~13,000 RCF for 5 min.
7. Remove the supernatant and then dry the pellet using a vacuum centrifuge or by leaving the tube open in a biosafety hood.
8. Resuspend the pellet in 30 μL in sterile water.

DNA amplicons are sequenced using methods known in the art, for example Sanger sequencing (Johnston-Monje and Raizada 2011, PLoS ONE 6(6): e20396) using one of the two primers used for amplification.

The resulting sequences are aligned as query sequences with the publicly available databases GenBank nucleotide, RDP (Wang et al. 2007), UNITE (Abarenkov et al., 2010, New Phytologist 186(2): 281-285 and PlutoF (Abarenkov et al. 2010b, Evol Bioinform 189-196). RDP is specifically compiled and used for bacterial 16s classification. UNITE and PlutoF are specifically compiled and used for identification of fungi. In all the cases, the isolates are identified to species level if their sequences are more than 95% similar to any identified accession from all databases analyzed (Zimmerman and Vitousek 2012, 109(32):13022-13027). When the similarity percentage is between 90-97%, the isolate is classified at genus, family, order, class, subdivision or phylum level depending on the information displayed in databases used. Isolates with lower similarity values (from 30-90%) are classified as unknown or uncultured depending on the information displayed after BLAST analysis. To support the molecular identification, fungal taxa are confirmed by inducing sporulation on PDA or V8 agar plates and using reported morphological criteria for identification of fruiting bodies structure and shape (Ainsworth et al. 2008, Ainsworth & Bisby's Dictionary of the Fungi" 2008, CABI). Bacterial taxa are confirmed by using reported morphological criteria in specialized differential media for the particular taxon, or by biochemical differentiation tests, as described by the Bergey's Manual of Systematic Bacteriology (2012) V:1-5. Springer.

Culture-Independent Characterization of Fungal and Bacterial Communities in Seeds or Plants Example Description To understand the diversity of culturable and unculturable microbial (bacterial and fungal) taxa that reside inside of seeds or plants of agriculturally-relevant cultivars, landraces, and ancestral wild varieties, microbial DNA is extracted from surface sterilized seed or plant parts, followed by amplification of conserved genomic regions like the ribosomal DNA loci. Amplified DNA represents a "snapshot" of the full microbial community inside seeds or plants.

Description of Methods

To obtain microbial DNA from seeds, plants or plant parts, the seeds, plants or plant parts are surface sterilized under aseptic conditions as described herein. Microbial DNA from seeds, plants, or plant parts is extracted using methods known in the art, for example using commercially available Seed-DNA or plant DNA extraction kits, or the following method.

1. A sample of each kind of seed or plant tissue is placed in a cold-resistant container and 10-50 mL of liquid nitrogen is applied. The seeds or plant tissues are then macerated to a powder.

Genomic DNA is extracted from each seed or plant tissue preparation, following a chloroform:isoamyl alcohol 24:1 protocol (Green and Sambrook 2012). Fungal-specific primers are used to amplify the ITS (Internal Transcribed Spacer) region of nuclear ribosomal DNA (Schoch et al. 2012, PNAS 109(16):6241-6246). Bacterial specific primers are used to amplify region of the 16s rDNA gene of the bacterial genome (Caporaso et al. 2012, The ISME Journal 6(8): 1621-1624). Sequences obtained through NGS platforms are analyzed against databases, such as the ones mentioned herein. Some of the primer pairs used for this analysis are detailed below (Table 25).

TABLE 25

Primer pairs used for taxonomic identification of bacterial and fungal OTUs from environmental DNA.

| Primer 1 | Primer 2 | Reference |
|---|---|---|
| V4_515F (see above) | V4_806R (see above) | |
| Target | The 4$^{th}$ Variable region of the bacterial 16S rDNA | |
| 27F (see above) | 1492R (see above) | |
| Target | Full length of the bacterial 16S rDNA, from position 8-1507. | |
| ITS1 (see above) | ITS2 (see above) | |
| Target | ~240 bp ITS1 region of fungal genome | |
| SR1R (see above) | SR6 (see above) | |
| Target | Small subunit (18S) of the fungal rDNA gene | |
| ITS1F (5'-CTTGGTCATTT AGAGGAAGTAA-3') | ITS4 (5'-TCCTCCGCTT ATTGATATGC-3') | |
| Target | ~600-1000 bp ITS region of fungal genomes | (Manter & Vivanco 2007) |

TABLE 25-continued

Primer pairs used for taxonomic identification of bacterial and fungal OTUs from environmental DNA.

| Primer 1 | Primer 2 | Reference |
|---|---|---|
| ITS5 (Universal) (5'-GGAAGTAAAAG TCGTAACAAGG-3') | ITS4Asco (Ascomycota-specific): 5' CGTTACTRRGGCA ATCCCTGTTG 3' or ITS4Basidio (Basidiomycota-specific): 5' GCRCGGAARAC GCTTCTC 3'; or ITS4Chytrid (Chytridiomycota-specific): 5' TTTTCCCGTTTC ATTCGCCA 3'; or ITS4Oo (Oomycota-specific): 5' ATAGACTACAA TTCGCC 3'; or ITS4Zygo (Zygomycota-specific): 5' AAAACGTWT CTTCAAA 3'. | |
| Target | ~500 bp fragment from different fungal Phyla depending on primer combination used. | (Kikolchva & Barlochev 2004, Mycological Progress 3(1):41-49) |
| SSUmAf- (equimolar mix of 2 degenerate primers) and SSUmCf (equimolar mix of 3 degenerate primers) | LSUmAr (equimolar mix of 4 degenerate primers) and LSUmBr (equimolar mix of 5 degenerate primers) | |
| Target | 1000-1600 bp fragment of the Glomerycota (arbuscular mycorrhizae) genome including partial SSU, whole internal transcribed spacer (ITS) rDNA region and partial LSU. | (Kruger et al. 2009, New Phytol 183(1):212-223) |
| Arch 340F (5'-CCCTAYGGG GYGCASCAG-3') | Arch 1000R (5'-GAGARGWRG TGCATGGCC-3') | |
| Target | ~660 bp product of the 18S from Archaea | (Ganter et al. 2011, J Microbiol Methods 84(1):12-18) |
| 27F-Degen (5'-AGRRTTYGAT YMTGGYTYAG-3') and 799f (5'-AACMGGATTA GATACCCKG-3') | 27F-Degen (5'-HGGHTACCTT GTTACGACTT-3') | |
| Target | Full length of the bacterial 16S rDNA, from position 8-1507. | (Johnston-Monje & Raizada 2011, supra) |

As an alternative to next generation sequencing, Terminal Restriction Fragment Length Polymorphism, (TRFLP) can be performed, essentially as described in Johnston-Monje and Raizada (2011), supra. Group specific, fluorescently labeled primers are used to amplify diagnostic regions of genes in the microbial population. This fluorescently labeled PCR product is cut by a restriction enzyme chosen for heterogeneous distribution in the PCR product population. The enzyme cut mixture of fluorescently labeled and unlabeled DNA fragments is then submitted for sequence analysis on a Sanger sequence platform such as the Applied Biosystems 3730 DNA Analyzer.

Determination of the Plant Pathogenic Potential of Microbial Isolates

A general assay is used to determine the pathogenic potential of the isolates. Surface and interior-sterilized seeds are germinated in water agar, and once the plant develops its first set of leaves, are inoculated with the isolate. Alternatively, the plants are inoculated as seeds. For inoculation the microbial isolate is grown on solid media, and inoculated into a plant or onto a seed via any of the methods described herein. Plants are allowed to grow under ideal conditions for 2-3 weeks and any pathogenic effect of the introduced microbe is evaluated against non-non-inoculated control plants.

Testing for Microbial Traits In Vitro

Examples below are adapted from Johnston-Monje and Raizada (2011).

Assay for Growth on Nitrogen Free LGI Media.

All glassware is cleaned with 6 M HCl before media preparation. A new 96 deep-well plate (2 mL well volume) is filled with 1 mL well$^{-1}$ of sterile LGI broth [per L, 50 g Sucrose, 0.01 g FeCl$_3$-6H$_2$O, 0.8 g K3PO$_4$, 0.2 g MgSO$_4$-7H$_2$O, 0.002 g Na$_2$MoO$_4$-2H$_2$O, pH 7.5]. Bacteria are inoculated with a flame-sterilized 96 pin replicator. The plate is sealed with a breathable membrane, incubated at 25° C. with gentle shaking for 5 days, and OD$_{600}$ readings taken.

ACC Deaminase Activity Assay.

Microbes are assayed for growth with ACC as their sole source of nitrogen. Prior to media preparation all glassware is cleaned with 6 M HCl. A 2 M filter sterilized solution of ACC (#1373A, Research Organics, USA) is prepared in water. One µl mL$^{-1}$ of this is added to autoclaved LGI broth (see above), and 1 mL aliquots are placed in a new 96 well plate. The plate is sealed with a breathable membrane, incubated at 25° C. with gentle shaking for 5 days, and OD600 readings taken. Only wells that are significantly more turbid than their corresponding nitrogen free LGI wells are considered to display ACC deaminase activity.

RNAse Activity Assay

Torula yeast RNA (1.5 g, #R6625, Sigma) is dissolved in 1 mL of 0.1 M Na$_2$HPO$_4$ at pH 8, filter sterilized and added to 250 mL of autoclaved R2A agar media which is poured into 150 mm plates. The bacteria from a glycerol stock plate are inoculated using a flame-sterilized 96 pin replicator, and incubated at 25° C. for 3 days. On day three, plates are flooded with 70% perchloric acid (#311421, Sigma) for 15 minutes and scored for clear halo production around colonies.

Siderophore Production Assay

To ensure no contaminating iron is carried over from previous experiments, all glassware is deferrated with 6 M HCl and water prior to media preparation. In this cleaned glassware, R2A agar media, which is iron limited, is prepared and poured into 150 mm Petri dishes and inoculated with bacteria using a 96 pin plate replicator. After 3 days of incubation at 25° C., plates are overlaid with O-CAS overlay. Again using the cleaned glassware, 1 liter of O-CAS overlay is made by mixing 60.5 mg of Chrome azurol S (CAS), 72.9 mg of hexadecyltrimethyl ammonium bromide (HDTMA), 30.24 g of finely crushed Piperazine-1,4-bis-2-ethanesulfonic acid (PIPES) with 10 mL of 1 mM $FeCl_3.6H_2O$ in 10 mM HCl solvent. The PIPES had to be finely powdered and mixed gently with stirring (not shaking) to avoid producing bubbles, until a dark blue color is achieved. Melted 1% agarose is then added to pre-warmed O-CAS just prior pouring the overlay in a proportion of 1:3 (v/v). After 15 minutes, color change is scored by looking for purple halos (catechol type siderophores) or orange colonies (hydroxamate siderophores).

Pectinase Activity Assay

Adapting a previous protocol 0.2% (w/v) of citrus pectin (#76280, Sigma) and 0.1% triton X-100 are added to R2A media, autoclaved and poured into 150 mm plates. Bacteria are inoculated using a 96 pin plate replicator. After 3 days of culturing in the darkness at 25° C., pectinase activity is visualized by flooding the plate with Gram's iodine. Positive colonies are surrounded by clear halos.

Cellulase Activity Assay

Adapting a previous protocol, 0.2% carboxymethylcellulose (CMC) sodium salt (#C5678, Sigma) and 0.1% triton X-100 are added to R2A media, autoclaved and poured into 150 mm plates. Bacteria are inoculated using a 96 pin plate replicator. After 3 days of culturing in the darkness at 25° C., cellulose activity is visualized by flooding the plate with Gram's iodine. Positive colonies are surrounded by clear halos.

Antibiosis Assay

Bacteria are inoculated using a 96 pin plate replicator onto 150 mm Petri dishes containing R2A agar, then grown for 3 days at 25° C. At this time, colonies of either the bacteria *E. coli* DH5α (gram negative tester), *Bacillus subtilus* ssp. *subtilis* (gram positive tester), or yeast AH109 (fungal tester) are resuspended in 1 mL of 50 mM Na2HPO$_4$ buffer to an $OD_{600}$ of 0.2, and 30 μl of this is mixed with 30 mL of warm LB agar. This is quickly poured completely over a microbe array plate, allowed to solidify and incubated at 37° C. for 16 hours. Antibiosis is scored by looking for clear halos around microbial colonies.

Generating/Isolating Endophytes Compatible with Agrochemicals

The application of pesticides against fungal pathogens of agriculturally-relevant plants is a common practice in agriculture to ensure higher yields. One method of pesticide delivery is to coat the seeds with pesticides. Although pesticides are meant to deter the growth and propagation of pathogenic microorganisms, they may also affect endophyte populations residing inside of the seed. For this purpose, conferring compatibility mechanisms to endophytic fungi providing beneficial properties which are sensitive to these compounds is desirable for the maintenance of endophytes in the seeds.

Compatibility with pesticides can be intrinsic (naturally pesticide compatible fungi, for example) or acquired (due to mutations in the genetic material of the microorganism, or to the introduction of exogenous DNA by natural DNA transfer).

Fungicides used as protectants are effective only on the seed surface, providing protection against seed surface-borne pathogens and providing some level of control of soil-borne pathogens. These products generally have a relatively short residual. Protectant fungicides such as captan, maneb, thiram, or fludioxonil help control many types of soil-borne pathogens, except root rotting organisms. Systemic fungicides are absorbed into the emerging seedling and inhibit or kill susceptible fungi inside host plant tissues. Systemic fungicides used for seed treatment include the following: azoxystrobin, carboxin, mefenoxam, metalaxyl, thiabendazole, trifloxystrobin, and various triazole fungicides, including difenoconazole, ipconazole, tebuconazole, and triticonazole. Mefenoxam and metalaxyl are primarily used to target the oomycetes such as species of *Pythium* and *Phytophthora*.

Strobilurin analogues, such as azoxystrobin, inhibit mitochondrial respiration by blocking electron transfer at the cytochrome bc1 complex. Phenylamides, including metalaxyl, interfere with RNA synthesis in target fungi. Oxathiin systemic fungicides like carboxin inhibits the incorporation of phenylalanine into protein and of uracil into RNA. Azole fungicides BAS 480F, flusilazole, and tebuconazole are inhibitors of sterol 14α-demethylase, and block sterol biosynthesis.

Determination of Intrinsic Resilience Against Agrochemicals of Bacteria Cultured from Seeds To test the intrinsic resilience pesticides of bacteria isolated as described herein, minimum inhibitory concentration (MIC) assays are performed on all isolated bacteria of interest, as described by Weigand and colleagues (2008) Nature Protocols 3(2):163-175. Briefly, known concentrations of bacterial cells or spores are used to inoculate plates containing solid media with different concentrations of the pesticide, or to inoculate liquid media containing different concentrations of the pesticide (in a 96-well plate). The pesticides are used at the concentration recommended by the manufacturer for seed coating, and two-fold dilutions down to 0.000125 (12 two-fold dilutions). Growth is assessed after incubation for a defined period of time (16-20 h) and compared to cultures grown in the same manner without any pesticides as control. The MIC value is then determined.

Determination of Intrinsic Resilience Against Agrochemicals of Fungi Cultured from Seeds To test the intrinsic resilience against pesticides of the fungi isolated as described in this application, minimum inhibitory concentration (MIC) assays are performed on all isolated fungi of interest, as described Mohiddin and Khan (2013) African J Ag Res 8(43): 5331-5334, with the following changes: Briefly, double strength potato dextrose agar is prepared containing different concentrations of each pesticide. The pesticides are applied at the concentration recommended by the manufacturer, and also in two fold dilutions to 0.000125× (12 two-fold dilutions). Thereafter, the plates are seeded centrally with a 3 mm disc of 4 days old culture of each fungus that had been centrifuged and rinsed twice in sterile phosphate buffer. PDA plates without a fungicide but inoculated with the fungi serve as a control. The inoculated plates are incubated at 25±2° C. for 5 days. The radial growth of the colony in each treatment is measured and the percent inhibition of growth is calculated. Fungal isolates are classified as resilience against the particular pesticide if their maximum tolerance concentration (MTC) is 2× or above the concentration of pesticides recommended to be used in seed coatings.

Generating Fungal Species with Compatibility with Commercial Pesticides Coated onto Seeds When a fungal endophyte of interest that provides a beneficial property to its plant host is found to be sensitive to a commercially-relevant pesticide, pesticide-compatible variants of the isolates need to be generated for use in this application. Generation of compatibility to multiple pesticides or cocktails of pesticides is accomplished by sequentially selecting compatible variants to each individual pesticide and then confirming compatibility with a combination of the pesticides. After each round of selection, fungi are tested for their ability to form symbiotic relationships with the plants and to confirm that they provide a beneficial property on the plant as did the parental isolate, with or without application of the pesticide product as described herein.

Generation and isolation of pesticide-compatible isolates derived from endophytic fungi isolated from seeds and shown to provide beneficiary traits to plants is performed as described by Shapiro-Ilan and colleagues (2002, J Invert Path 81(2):86-93) with several modifications. Briefly, spores of the isolated fungi are collected and solutions containing between ~$1\times10^3$ spores are used to inoculate potato dextrose agar (PDA) plates containing 2, 5, and 10 times the MTC of the particular isolate. Plates are incubated for 1-5 days and a single colony from the highest concentration of pesticide which allows growth is inoculated onto a fresh plate with the same pesticide concentration 7 consecutive times. After compatibility has been established, the endophyte is inoculated onto PDA plates 3 consecutive times and then inoculated onto a PDA plate containing the pesticide to confirm that the compatibility trait is permanent.

Alternatively, if this method fails to provide a compatible isolate, a spore suspension is treated with ethyl methanesulfonate to generate random mutants, similarly as described by Leonard and colleagues (2013, Int J Micro Article ID 901697) and spores from this culture are used in the experiment detailed above.

To develop fungal endophytes compatible with multiple pesticides or cocktails of pesticides, spores of an endophyte compatible with one or more pesticides are used to select for variants to a new pesticide as described above. Endophytes developed this way are tested for retention of the pesticide-compatibility traits by inoculating then onto PDA plates containing each single pesticide or combinations of pesticides.

Generating Bacterial Species with Compatibility to Commercial Pesticides Coated onto Seeds When a bacterial endophyte of interest is found to be sensitive to a commercially-relevant pesticide, generation of pesticide-compatible variants of the isolates can be generated for use in this application. Generation of compatible with multiple pesticides or cocktails of pesticides is accomplished by first sequentially selecting variants compatible with incrementally higher concentrations of each individual pesticide (Thomas et al. 2000, J Hospital Inf 46(4):297-303). To develop bacterial endophytes compatible with multiple pesticides or cocktails of pesticides, bacterial cells of an endophyte compatible with one or more pesticides is used to select for variants to a new pesticide as described above. Endophytes developed this way are tested for retention of the pesticide-compatible traits by inoculating these isolates onto PDA plates containing each single pesticide or combinations of pesticides.

After each round of selection, bacteria are tested for their ability to live within plants and for their ability to provide the same beneficial property to the plant as did the parental endophyte, with or without application of the pesticide product to the plants as described herein.

Generation of Pesticide-Compatible Bacteria by Insertion of a Resistance Plasmid Many bacterial plasmids that confer compatible pesticides have been described in the literature (Don and Pemberton, 1989, J Bacteriol 145(2):681-686. See also Fisher et al. 1978, J Bacteriol 135(3):798-804.

For cases in which obtaining naturally occurring compatible bacteria is not feasible, use of these plasmids is a possible way to develop endophytic isolates compatible with multiple pesticides.

For example, a *Pseudomonas fluorescens* isolate that provides anti-nematode properties to plants but is sensitive to the pesticides 2,4-dichlorophenoxyacetic acid and 4-chloro-2-methylphenoxyacetic can be transformed with the plasmid pJP2 (isolated from *Alcaligenes eutrophus*) which provides transmissible compatible with these compounds, as described by Don and Pemberton (1981), supra. Briefly, plasmids are transferred by conjugation to *Pseudomonas*, using the method described by Haas and colleagues (1976), Mol and Gen Genetics 144(3):243-251.

After the generation of bacteria carrying pesticide-compatibility conferring plasmids, these endophytes are tested for their ability to live inside plant tissues and for their ability to provide the same beneficial property to the plant as it did for the parental isolate, with or without application of the pesticide product to the plants as described herein.

Growth & Scale-Up of Bacteria for Inoculation on Solid Media

The bacterial isolates are grown by loop-inoculation of a single colony into R2A broth (supplemented with appropriate antibiotics) in 100 mL flasks. The bacterial culture is incubated at 30±2° C. for 2 days at 180 rpm in a shaking incubator (or under varying temperatures and shaking speeds as appropriate). This liquid suspension is then used to inoculate heat sterilized vermiculite powder which is premixed with sterile R2A broth (without antibiotics), resulting in a soil like mixture of particles and liquid. This microbial powder is then incubated for an additional couple of days at 30±2° C. with daily handshaking to aerate the moist powder and allow bacterial growth. Microbially inoculated vermiculite powder is now ready for spreading on to soil or onto plant parts. Alternatively, the R2A broth is used to inoculate Petri dishes containing R2A or another appropriate nutrient agar where lawns of bacteria are grown under standard conditions and the solid colonies scraped off, resuspended in liquid and applied to plants as desired.

Growth & Scale-Up of Fungi for Inoculation on Solid Media

Once a fungal isolate has been characterized, conditions are optimized for growth in the lab and scaled-up to provide sufficient material for assays. For example, the medium used to isolate the fungus is supplemented with nutrients, vitamins, co-factors, plant-extracts, and other supplements that can decrease the time required to grow the fungal isolate or increase the yield of mycelia and/or spores the fungal isolate produces. These supplements can be found in the literature or through screening of different known media additives that promote the growth of all fungi or of the particular fungal taxa.

To scale up the growth of fungal isolates, isolates are grown from a frozen stock on several Petri dishes containing media that promotes the growth of the particular fungal isolate and the plates are incubated under optimal environmental conditions (temperature, atmosphere, light). After mycelia and spore development, the fungal growth is scraped and resuspended in 0.05 M Phosphate buffer (pH 7.2, 10 mL plate$^{-1}$). Disposable polystyrene Bioassay dishes (500 cm$^2$, Thermo Scientific Nunc UX-01929-00) are prepared with 225 mL of autoclaved media with any required supplements added to the media, and allowed to solidify. Plates are stored at room temperature for 2-5 days prior to inoculation to confirm sterility. Five mL of the fungal suspension is spread over the surface of the agar in the Bioassay plate in a biosafety cabinet, plates are allowed to dry for 1 h, and they are then incubated for 2-5 days, or until mycelia and/or spores have developed.

A liquid fungal suspension is then created via the following. Fungal growth on the surface of the agar in the Bioassay plates are then scraped and resuspended in 0.05 M Phosphate buffer (pH 7.2). $OD_{600}$ readings are taken using a spectrometer and correlated to previously established $OD_{600}$/CFU counts to estimate fungal population densities, and the volume adjusted with additional sodium phosphate buffer to result in 100 mL aliquots of fungi at a density of approximately $10^6$-$10^{11}$ spores mL$^{-1}$. This suspension may or may not be filtered to remove mycelia and can be used to create a liquid microbial formulation as described herein to apply the fungal isolate onto a plant, plant part, or seed.

Growth & Scale-Up of Bacteria for Inoculation in Liquid Media

Bacterial endophytes are grown by loop-inoculation of one single colony into R2A broth (amended with the appropriate antibiotics) in 100 L flasks. The bacterial culture is incubated at 30±2° C. for 2 days at 180 rpm in a shaking incubator (or under varying temperatures and shaking speeds as appropriate). The bacteria are pelleted by centrifugation and resuspended in sterile 0.1 M sodium phosphate. OD600 readings are taken using a spectrometer and correlated to previously established OD600/CFU counts to estimate bacterial population densities, and the volume adjusted with additional sodium phosphate buffer to result in 100 mL aliquots of bacteria at a density of 1×10$^8$ cells mL$^{-1}$. To help break surface tension, aid bacterial entry into plants and provide microbes for some energy for growth, 10 µL of Silwet L-77 surfactant and 1 g of sucrose is added to each 100 mL aliquot (resulting in 0.01% v/v and 1% v/v concentrations, respectively) in a similar way as in the protocol for *Agrobacterium*-mediated genetic transformation of *Arabidopsis thaliana* seed (Clough and Bent 1999, The Plant Journal 16(6): 735-743).

Growth & Scale-Up of Fungi for Inoculation in Liquid Media

Once a fungal isolate has been characterized, conditions are optimized for growth in the lab and scaled-up to provide enough material for assays. For example, the medium used to isolate the fungi is supplemented with nutrients, vitamins, co-factors, plant-extracts, and/or other supplements that can decrease the time required to grow the fungal isolate and/or increase the yield of mycelia and/or spores the fungal isolate produces. These supplements can be found in the literature or through screening of different known media additives that promote the growth of all fungi or of the particular fungal taxa.

To scale up the growth of fungal isolates, isolates are grown from a frozen stock on Petri dishes containing media that promotes the growth of the particular fungal isolate and the plates are incubated under optimal environmental conditions (temperature, atmosphere, light). After mycelia and spore development, the fungal growth is scraped and resuspended in 0.05M Phosphate buffer (pH 7.2, 10 mL plate$^{-1}$). 1 liter of liquid media selected to grow the fungal culture is prepared in 2 L glass flasks and autoclaved and any required supplements added to the media. These are stored at room temperature for 2-5 days prior to inoculation to confirm sterility. 1 mL of the fungal suspension is added aseptically to the media flask, which is then incubated for 2-5 days, or until growth in the liquid media has reached saturation. $OD_{600}$ readings are taken using a spectrometer and correlated to previously established $OD_{600}$/CFU counts to estimate fungal population densities, and the volume adjusted with additional sodium phosphate buffer to result in 100 mL aliquots of fungi at a density of approximately $10^6$-$10^{11}$ spores mL$^{-1}$. This suspension may or may not be filtered to remove mycelia and can be used to create a liquid microbial formulation as described herein to apply the fungal isolate onto a plant, plant part, or seed.

Creation of Liquid Microbial Formulations or Preparations for the Application of Microbes to Plants Bacterial or fungal cells are cultured in liquid nutrient broth medium to between $10^2$-$10^{12}$ CFU mL$^{-1}$. The cells are separated from the medium and suspended in another liquid medium if desired. The microbial formulation may contain one or more bacterial or fungal isolates. The resulting formulation contains living cells, lyophilized cells, or spores of the bacterial or fungal isolates. The formulation may also contain water, nutrients, polymers and binding agents, surfactants or polysaccharides such as gums, carboxymethylcellulose and polyalcohol derivatives. Suitable carriers and adjuvants can be solid or liquid and include natural or regenerated mineral substances, solvents, dispersants, wetting agents, tackifiers, thickeners, binders or fertilizers. Compositions can take the form of aqueous solutions, oil-in-water emulsions, or water-in-oil emulsions. Small amounts of insoluble material can optionally be present, for example in suspension in the medium, but it is generally preferred to minimize the presence of such insoluble material.

Inoculation of Plants by Coating Microbes Directly onto Seed

Seed is treated by coating it with a liquid microbial formulation (prepared as described herein) including microbial cells and other formulation components, directly onto the seed surface at the rate of $10^2$-$10^8$ microbial CFU per seed. Seeds are soaked in liquid microbial formulation for 1, 2, 3, 5, 10, 12, 18 or 24 hours or 2, 3, or 5 days. After soaking in microbial formulation, seeds are planted in growing containers or in an outdoor field. Seeds may also be coated with liquid microbial formulation by using an auger or a commercial batch treater. One or more microbial formulations or other seed treatments are applied concurrently or in sequence. Treatment is applied to the seeds using a variety of conventional treatment techniques and machines, such as fluidized bed techniques, augers, the roller mill method, rotostatic seed treaters, and drum coaters. Other methods, such as spouted beds may also be useful. The seeds are pre-sized before coating. Optionally the microbial formulation is combined with an amount of insecticide, herbicide, fungicide, bactericide, or plant growth regulator, or plant micro- or macronutrient prior to or during the coating process. After coating, the seeds are typically dried and then transferred to a sizing machine for grading before planting. Following inoculation, colonization of the plants or seeds produced therefrom is confirmed via any of the various methods described herein. Growth promotion or stress resilience benefits to the plant are tested via any of the plant growth testing methods described herein.

Inoculation of Plants with a Combination of Two or More Microbes

Seeds can be coated with bacterial or fungal endophytes. This method describes the coating of seeds with two or more bacterial or fungal isolates. The concept presented here involves simultaneous seed coating of two microbes (e.g., both a gram negative endophytic bacterium *Burkholderia phytofirmans* and a gram positive endophytic bacterium *Bacillus mojavensis*). Optionally, both microbes are genetically transformed by stable chromosomal integration as follows. *Bacillus mojavensis* are transformed with a construct with a constitutive promoter driving expression of a synthetic operon of GFPuv and spectinomycin resistance genes, while *Burkholderia phytofirmans* are transformed with a construct with a constitutive promoter driving expression of the lac operon with an appended spectinomycin resistance gene. Seeds are coated with a prepared liquid formulation of the two microbes the various methods described herein. Various concentrations of each endophyte in the formulation are applied, from $10^2$ seed$^{-1}$ to about $10^8$ seed$^{-1}$. Following inoculation, colonization of the plants or seeds produced therefrom may be confirmed via any of the various methods described herein. Growth promotion or stress resilience benefits to the plant are tested via any of the plant growth testing methods described herein.

Culturing to Confirm Colonization of Plant by Bacteria

The presence in the seeds or plants of GFPuv or gusA-labeled endophytes can be detected by colony counts from mashed seed material and germinated seedling tissue using R2A plates amended with 5-Bromo-4-chloro-3-indolyl β-D-glucuronide (X-glcA, 50 µg mL$^{-1}$), IPTG (50 µg mL$^{-1}$) and the antibiotic spectinomycin (100 µg mL$^{-1}$). Alternatively, bacterial or fungal endophytes not having received transgenes can also be detected by isolating microbes from plant, plant tissue or seed homogenates (optionally surface-sterilized) on antibiotic free media and identified visually by colony morphotype and molecular methods described herein. Representative colony morphotypes are also used in colony PCR and sequencing for isolate identification via ribosomal gene sequence analysis as described herein. These trials are repeated twice per experiment, with 5 biological samples per treatment.

Culture-Independent Methods to Confirm Colonization of the Plant or Seeds by Bacteria or Fungi Example Description One way to detect the presence of endophytes on or within plants or seeds is to use quantitative PCR (qPCR). Internal colonization by the endophyte can be demonstrated by using surface-sterilized plant tissue (including seed) to extract total DNA, and isolate-specific fluorescent MGB probes and amplification primers are used in a qPCR reaction. An increase in the product targeted by the reporter probe at each PCR cycle therefore causes a proportional increase in fluorescence due to the breakdown of the probe and release of the reporter. Fluorescence is measured by a quantitative PCR instrument and compared to a standard curve to estimate the number of fungal or bacterial cells within the plant.

Description of Methods

The design of both species-specific amplification primers, and isolate-specific fluorescent probes are well known in the art. Plant tissues (seeds, stems, leaves, flowers, etc.) are pre-rinsed and surface sterilized using the methods described herein.

Total DNA is extracted using methods known in the art, for example using commercially available Plant-DNA extraction kits, or the following method.

1. Tissue is placed in a cold-resistant container and 10-50 mL of liquid nitrogen is applied. Tissues are then macerated to a powder.
2. Genomic DNA is extracted from each tissue preparation, following a chloroform:isoamyl alcohol 24:1 protocol (Green and Sambrook 2012).

Quantitative PCR is performed essentially as described by Gao and colleagues (2010, J Clin Microbiol 48(10):3575-3581). Primers and probe(s) specific to the desired isolate are used with a quantitative PCR instrument, and a standard curve is constructed by using serial dilutions of cloned PCR products corresponding to the specie-specific PCR amplicon produced by the amplification primers. Data are analyzed using instructions from the quantitative PCR instrument's manufacturer software.

As an alternative to qPCR, Terminal Restriction Fragment Length Polymorphism, (TRFLP) can be performed, essentially as described in Johnston-Monje and Raizada (2011). Group specific, fluorescently labelled primers are used to amplify a subset of the microbial population, especially bacteria, especially fungi, especially archaea, especially viruses. This fluorescently labelled PCR product is cut by a restriction enzyme chosen for heterogeneous distribution in the PCR product population. The enzyme cut mixture of fluorescently labelled and unlabeled DNA fragments is then submitted for sequence analysis on a Sanger sequence platform such as the Applied Biosystems 3730 DNA Analyzer.

Immunological Methods to Detect Microbes in Seeds and Vegetative Tissues

A polyclonal antibody is raised against specific bacteria X or fungus Y isolates via standard methods. A polyclonal antibody is also raised against specific GUS and GFP proteins via standard methods. Enzyme-linked immunosorbent assay (ELISA) and immunogold labeling is also conducted via standard methods, briefly outlined below.

Immunofluorescence microscopy procedures involve the use of semi-thin sections of seed or seedling or adult plant tissues transferred to glass objective slides and incubated with blocking buffer (20 mM Tris (hydroxymethyl)-aminomethane hydrochloride (TBS) plus 2% bovine serum albumin, pH 7.4) for 30 min at room temperature. Sections are first coated for 30 min with a solution of primary antibodies and then with a solution of secondary antibodies (goat anti-rabbit antibodies) coupled with fluorescein isothiocyanate (FITC) for 30 min at room temperature. Samples are then kept in the dark to eliminate breakdown of the light-sensitive FITC. After two 5-min washings with sterile potassium phosphate buffer (PB) (pH 7.0) and one with double-distilled water, sections are sealed with mounting buffer (100 mL 0.1 M sodium phosphate buffer (pH 7.6) plus 50 mL double-distilled glycerine) and observed under a light microscope equipped with ultraviolet light and a FITC Texas-red filter.

Ultrathin (50- to 70-nm) sections for TEM microscopy are collected on pioloform-coated nickel grids and are labeled with 15-nm gold-labeled goat anti-rabbit antibody. After being washed, the slides are incubated for 1 h in a 1:50 dilution of 5-nm gold-labeled goat anti-rabbit antibody in IGL buffer. The gold labeling is then visualized for light microscopy using a BioCell silver enhancement kit. Toluidine blue (0.01%) is used to lightly counterstain the gold-labeled sections. In parallel with the sections used for immunogold silver enhancement, serial sections are collected on uncoated slides and stained with 1% toluidine blue. The sections for light microscopy are viewed under an optical microscope, and the ultrathin sections are viewed by TEM.

Characterization of Uniformity of Endophytes in a Population of Seeds

To test for the homogeneity of endophytes either on the surface or colonizing the interior tissues in a population of seeds, seeds are tested for the presence of the microbes by culture-dependent and/or -independent methods. Seeds are obtained, surface sterilized and pulverized, and the seed homogenate is divided and used to inoculate culture media or to extract DNA and perform quantitative PCR. The homogeneity of colonization in a population of seeds is assessed through detection of specific microbial isolates via these methods and comparison of the culture-dependent and culture-independent results across the population of seeds. Homogeneity of colonization for an endophyte of interest is rated based on the total number of seeds in a population that contain a detectable level of the isolate, on the uniformity across the population of the number of cells or CFU of the isolate present in the seed, or based on the absence or presence of other microbial endophytes in the seed.

Description of Methods

Surface sterilized seeds are obtained as described herein. For culture-dependent methods of microbial-presence confirmation, bacterial and fungi are obtained from seeds essentially as described herein with the following modification. Seed homogenate is used to inoculate media containing selective and/or differential additives that will allow to identification of a particular microbe.

For qPCR, total DNA of each seed is extracted using methods known in the art, as described herein.

Characterization of Homogeneity of Colonization in Population of Plants

To test for the homogeneity of microorganisms (including endophytes) colonizing the interior in a population of plants, tissues from each plant are tested for the presence of the microbes by culture-dependent and/or -independent methods. Tissues are obtained, surface sterilized and pulverized, and the tissue material is divided and used to inoculate culture media or to extract DNA and perform quantitative PCR. The homogeneity of colonization in a population of plants is assessed through detection of specific microbial isolates via these methods and comparison of the culture-dependent and culture-independent results across the population of plants or their tissues. Homogeneity of colonization for an endophyte of interest is rated based on the total number of plants in a population that contain a detectable level of the isolate, on the uniformity across the population of the number of cells or CFU of the isolate present in the plant tissue, or based on the absence or presence of other microbial endophytes in the plant.

Description of Methods

Surface sterilized plant tissues are obtained as described herein. For culture-dependent methods of microbial-presence confirmation, bacterial and fungi are obtained from plant tissues essentially as described herein with the following modification. Plant tissue homogenate is used to inoculate media containing selective and/or differential additives that will allow identification of a particular microbe.

For qPCR, total DNA of each plant tissue is extracted using methods known in the art, as described herein.

Testing for Beneficial and Inhibitory Effects of Endophytes
Testing for Germination Enhancement in Normal Conditions Standard Germination Tests are used to assess the ability of the endophyte to enhance the seeds' germination and early growth. Briefly, 400 seeds which are coated with the endophyte as described elsewhere are placed in between wet brown paper towels (8 replicates with 50 seeds each). An equal number of seeds obtained from control plants that do not contain the microbe is treated in the same way. The paper towels are placed on top of 1×2 feet plastic trays and maintained in a growth chamber set at 25° C. and 70% humidity for 7 days. The proportion of seeds that germinate successfully is compared between the seeds coming from microbe-colonized plants with those coming from controls.

Testing for Germination Enhancement Under Biotic Stress

A modification of the method developed by Hodgson (1961, Laboratory testing of the potato for partial resistance *Phytophthora infestans* 38(8):259-264) is used to test germination enhancement in microbe-colonized seeds under biotic stress (Hodgson 1961, supra). Biotic stress is understood as a concentration of inocula in the form of cell (bacteria) or spore suspensions (fungus) of a known pathogen for a particular crop (e.g., *Pantoea stewartii* or *Fusarium graminearum* for *Zea mays* L.). Briefly, for each level of biotic stress, 400 seeds, the interiors of which are colonized by microbial isolates, and 400 seed controls (lacking the microbial endophytes), are placed in between brown paper towels: 8 replicates with 50 seeds each for each treatment (microbe-colonized and control). Each one of the replicates is placed inside a large petri dish (150 mm in diameter). The towels are then soaked with 10 mL of pathogen cell or spore suspension at a concentration of $10^4$ to $10^8$ cells/spores per mL. Each level corresponds with an order of magnitude increment in concentration (thus, 5 levels). The petri dishes are maintained in a growth chamber set at 25° C. and 70% humidity for 7 days. The proportion of seeds that germinate successfully is compared between the seeds coming from microbe-colonized plants with those coming from controls for each level of biotic stress.

Testing for Germination Enhancement Under Drought Stress

Polyethylene glycol (PEG) is an inert, water-binding polymer with a non-ionic and virtually impermeable long chain that accurately mimics drought stress under dry-soil conditions (Couper and Eley 1984, J. Polymer Sci., 3: 345-349). The higher the concentration of PEG, the lower the water potential achieved, thus inducing higher water stress in a watery medium. To determine germination enhancement in seeds, the interiors of which are colonized by microbial endophytes, the effect of osmotic potential on germination is tested at a range of water potential representative of drought conditions following Perez-Fernandez et al. (2006, J Environ Biol 27: 669-685). The range of water potentials simulates those that are known to cause drought stress in a range of cultivars and wild plants, (−0.05 MPa to −5 MPa) (Craine et al. 2013, Nature Climate Change 3:63-67). The appropriate concentration of polyethylene glycol (6000) required to achieve a particular water potential is determined following Michel and Kaufmann (1973, Plant Physiol 51:914-916) and further modifications by Hardegree and Emmerich (1990, Plant Physiol 92:462-466). The final equation used to determine amounts of PEG is: $\Psi=0.130 [PEG]^2 T-13.7 [PEG]^2$; where the osmotic potential ($\Psi$) is a function of temperature (T). Germination experiments are conducted in 90 mm diameter petri dishes. Replicates consist of a Petri dish, watered with 10 mL of the appropriate solution and 20 seeds floating in the solution. 400 seeds, the interiors of which are colonized by microbial endophytes are tested, in addition to 400 seed controls (lacking the microbial endophytes), totaling 40 petri dishes. To prevent large variations in $\Psi$, dishes are sealed with parafilm and the PEG solutions are renewed weekly by pouring out the existing PEG in the petri dish and adding the same amount of fresh solution. Petri dishes are maintained in a growth chamber set at 25° C., 16:8 hour light:dark cycle, 70% humidity, and least 120 $\mu E/m^2/s$ light intensity. The proportion of seeds that germinate successfully after two weeks is compared between the seeds coming from inoculated plants and those coming from controls.

Testing for Germination Enhancement in Heat Conditions

Standard Germination Tests are used to determine if a microbe colonizing the interior of a seed protects maize against heat stress during germination. Briefly, 400 seeds, the interiors of which are colonized by microbial endophytes are placed in between wet brown paper towels (8 replicates with 50 seeds each). An equal number of seeds obtained from control plants that lack the microbe is treated in the same way. The paper towels are placed on top of 1×2 ft plastic trays and maintained in a growth chamber set at 16:8 hour light:dark cycle, 70% humidity, and at least 120 $\mu E/m2/s$ light intensity for 7 days. A range of high temperatures (from 35° C. to 45° C., with increments of 2 degrees per assay) is tested to assess the germination of microbe-colonized seeds at each temperature. The proportion of seeds that germinate successfully is compared between the seeds coming from microbe-colonized plants and those coming from controls.

Testing for Germination Enhancement in Cold Conditions

Standard Germination Tests are used to determine if a microbe colonizing the interior of a seed protects maize against cold stress during germination. Briefly, 400 seeds, the interiors of which are colonized by microbial endophytes are placed in between wet brown paper towels (8 replicates with 50 seeds each). An equal number of seeds obtained from control plants that lack the microbe is treated in the same way. The paper towels are placed on top of 1×2 ft plastic trays and maintained in a growth chamber set at 16:8 hour light:dark cycle, 70% humidity, and at least 120 $\mu E/m2/s$ light intensity for 7 days. A range of low temperatures (from 0° C. to 10° C., with increments of 2 degrees per assay) is tested to assess the germination of microbe-colonized seeds at each temperature. The proportion of seeds that germinate successfully is compared between the seeds coming from microbe-colonized plants and those coming from controls.

Testing for Germination Enhancement in High Salt Concentrations

Germination experiments are conducted in 90 mm diameter petri dishes.

Replicates consist of a Petri dish, watered with 10 mL of the appropriate solution and 20 seeds floating in the solution. 400 seeds, the interiors of which are colonized by microbial endophytes, and 400 seed controls (lacking the microbial endophytes) are tested in this way (40 petri dishes total). To prevent large variations in salt concentration due to evaporation, dishes are sealed with parafilm and the saline solutions are renewed weekly by pouring out the existing saline solution in the petri dish and adding the same amount of fresh solution. A range of saline solutions (100-500 mM NaCl) is tested for to assess the germination of microbe-colonized seeds at varying salt levels. Petri dishes are maintained in a growth chamber set at 25° C., 16:8 hour light:dark cycle, 70% humidity, and at least 120 $\mu E/m^2/s$ light intensity. The proportion of seeds that germinates successfully after two weeks is compared between the seeds coming from inoculated plants and those coming from controls.

Testing for Germination Enhancement in Soils with High Metal Content

Standard Germination Tests are used to determine if a microbe colonizing the interior of a seed protects maize against stress due to high soil metal content during germination. Briefly, 400 seeds of maize, the interiors of which are colonized by microbial endophytes, are placed in between wet brown paper towels (8 replicates with 50 seeds each). An equal number of seeds obtained from control plants that lack the microbe (microbe-free) is treated in the same way. The paper towels are placed on top of 1×2 ft plastic trays with holes to allow water drainage. The paper towels are covered with an inch of sterile sand. For each metal to be tested, the sand needs to be treated appropriately to ensure the release and bioavailability of the metal. For example, in the case of aluminum, the sand is watered with pH 4.0+~1 g per kg soil Al+3 (~621 uM). The trays are maintained in a growth chamber set at 25° C. and 70% humidity for 7 days. The proportion of seeds that germinates successfully is compared between the seeds coming from microbe-colonized plants and those coming from controls.

Testing for Growth Promotion in Growth Chamber in Normal Conditions

Soil is made from a mixture of 60% Sunshine Mix #5 (Sun Gro; Bellevue, Wash., USA) and 40% vermiculite. To determine if a particular microbe colonizing the interior of seeds is capable of promoting plant growth under normal conditions, 24 pots are prepared in two 12-pot no-hole flat trays with 28 grams of dry soil in each pot, and 2 L of filtered water is added to each tray. The water is allowed to soak into the soil and the soil surface is misted before seeding. For each seed-microbe combination, 12 pots are seeded with 3-5 seeds colonized by the microbe and 12 pots are seeded with 3-5 seeds lacking the microbe (microbe-free plants). The seeded pots are covered with a humidity dome and kept in the dark for 3 days, after which the pots are transferred to a growth chamber set at 25° C., 16:8 hour light:dark cycle, 70% humidity, and at least 120 $\mu E/m2/s$ light intensity. The humidity domes are removed on day 5, or when cotyledons are fully expanded. After removal of the domes, each pot is irrigated to saturation with 0.5× Hoagland's solution, then allowing the excess solution to drain. Seedlings are then thinned to 1 per pot. In the following days, the pots are irrigated to saturation with filtered water, allowing the excess water to drain after about 30 minutes of soaking, and the weight of each 12-pot flat tray is recorded weekly. Canopy area is measured at weekly intervals. Terminal plant height, average leaf area and average leaf length are measured at the end of the flowering stage. The plants are allowed to dry and seed weight is measured. Significance of difference in growth between microbe-colonized plants and controls lacking the microbe is assessed with the appropriate statistical test depending on the distribution of the data at $p<0.05$.

Testing for Growth Promotion in Growth Chamber Under Biotic Stress

Soil is made from a mixture of 60% Sunshine Mix #5 (Sun Gro; Bellevue, Wash., USA) and 40% vermiculite. To determine if a particular microbe colonizing the interior of seeds is capable of promoting plant growth in the presence of biotic stress, 24 pots are prepared in two 12-pot no-hole flat trays with 28 grams of dry soil in each pot, and 2 L of filtered water is added to each tray. The water is allowed to soak into the soil before planting. For each seed-microbe combination test, 12 pots are seeded with 3-5 seeds colonized by the microbe and 12 pots are seeded with 3-5 seeds lacking the microbe (microbe-free plants). The seeded pots are covered with a humidity dome and kept in the dark for 3 days, after which the pots are transferred to a growth chamber set at 25° C., 16:8 hour light:dark cycle, 70% humidity, and at least 120 µE/m2/s light intensity. The humidity domes are removed on day 5, or when cotyledons are fully expanded. After removal of the domes, each pot is irrigated to saturation with 0.5× Hoagland's solution, allowing the excess solution to drain. Seedlings are then thinned to 1 per pot. In the following days, the pots are irrigated to saturation with filtered water, allowing the excess water to drain after about 30 minutes of soaking.

Several methods of inoculation are used depending on the lifestyle of the pathogen. For leaf pathogens (e.g., *Pseudomonas syringeae* or *Colletotrichum graminicola*), a suspension of cells for bacteria ($10^8$ cell $mL^{-1}$) or spores for fungi ($10^7$ spores $mL^{-1}$) is applied with an applicator on the adaxial surface of each of the youngest fully expanded leaves. Alternatively for fungal pathogens that do not form conidia easily, two agar plugs containing mycelium (~4 mm in diameter) are attached to the adaxial surface of each of the youngest leaves on each side of the central vein. For vascular pathogens (e.g., *Pantoea stewartii* or *Fusarium moniliforme*), the suspension of cells or spores is directly introduced into the vasculature (5-10 µL) through a minor injury inflected with a sterile blade. Alternatively, the seedlings can be grown hydroponically in the cell/spore or mycelium suspension. To test the resilience of the plant-microbe combination against insect stresses, such as *thrips* or aphids, plants are transferred to a specially-designated growth chamber containing the insects. Soil-borne insect or nematode pathogens are mixed into or applied topically to the potting soil. In all cases, care is taken to contain the fungal, insect, nematode or other pathogen and prevent release outside of the immediate testing area.

The weight of each 12-pot flat tray is recorded weekly. Canopy area is measured at weekly intervals. Terminal plant height, average leaf area and average leaf length are measured at the cease of flowering. The plants are allowed to dry and seed weight is measured. Significance of difference in growth between microbe-colonized plants and controls lacking the microbe is assessed with the appropriate statistical test depending on the distribution of the data at $p<0.05$.

OTHER EMBODIMENTS

It is to be understood that while the invention has been described in conjunction with the detailed description thereof, the foregoing description is intended to illustrate and not limit the scope of the invention, which is defined by the scope of the appended claims. Other aspects, advantages, and modifications are within the scope of the following claims.

SEQUENCE LISTING (1471 sequences)

SEQ ID NO: 1 - DNA, 687 bp, Burkholderia fungorum
cgacttggaggttgtgcccttgaggcgtggtttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaatttggcagagatgccttagtgccttcgggaaccgtgagacgggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcatatacaaagagaagcgacctcgcgagagcaagcggacctcataaagtatgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtacc

SEQ ID NO: 2 - DNA, 687 bp, Burkholderia fungorum
cgacttggaggttgtgcccttgaggcgtggcttcccgagctaacgcgttaagtcgaccgcctggggagtacggccgcaaggttaaaactcaaatgaattgacgggggcccgcacaagcggtggagcatgtggtttaattcgatgcaacgcgaagagccttacctggtcttgacatccacggaatttggcagagatgccttagtgccttcgggaaccgtgagacaggtgctgcatggctgtcgtcagctcgtgttgtgaaatattaggttaagtcccgcaacgagcgcaacccttatcctttgttgccagcggtccggccgggaactcaaaggagactgtcagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtatc

SEQ ID NO: 3 - DNA, 687 bp, Burkholderia gladioli
cgacttggaggttgtgcccttgaggcgtggcttccggagctaacgcgtcaagtcgaccgcctggggagtacggccgcaaggttaagactcaaatgaattgacgggggcccgcacaagcggtggagcatgtggtttaattcgatgcaacgcgaagaaccttacctactcttggcatccagagaactttccagagatggattggtgccttcgggaactctgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtatc

SEQ ID NO: 4 - DNA, 687 bp, Citrobacter freundii
cgacttggaggttgggcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaacttcgggagggcgcttaccactttgtgattcatgactggggtgaagtcgtaacaaggtacc

SEQ ID NO: 5 - DNA, 687 bp, Citrobacter freundii
cgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgagtagggctacacacgtgctacagtggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtagc

SEQ ID NO: 6 - DNA, 687 bp, Clostridium acetobutylicum
cgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgctgggttaagtcccgcaacgagcgcaacccttatcctttgttgccagcggtccggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtatc

SEQ ID NO: 7 - DNA, 687 bp, Clostridium beijerinckii
cgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgagccttgtacacaccgcccgtcacaccatgggagtgggttgcaaaagaagtaggtagcttaaacttcgggagggcgcttaccactttgtgattcatgactggggtgaagtcgtaacaaggtacc

SEQ ID NO: 8 - DNA, 687 bp, Enterobacter asburiae
cgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaatttggcagagatgccttagtgccttcgggaaccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcatatacaaagagaagcgacctcgcgagagcaagcggacctcataaagtatgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtagc

SEQ ID NO: 9 - DNA, 685 bp, Enterobacter asburiae
gacttggaggttgtgccttgaggcgtggcttcccgagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaatttggcagagatgccttagtgccttcgggaaccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcatatacaaagagaagcgacctcacgagagcaagcggacctcataaagtatgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaac

SEQ ID NO: 10 - DNA, 687 bp, Enterobacter aerogenes
cgacttggaggttgtgcccttgaggcgtggcttccggagctaacgcgttaagtcgaccgcctggggagtacggccgcaaggttaaaactcaaatgaattgacgggggcccgcacgagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgctgggttaagtcccgcaacgagcgcaacccttatcctttgttgccagcggtccggccgtgaactcaaaggagactgccagtgataaactggaggaaggtggggatgacgtcaagtcatcatggcccttacgagtagggctacacacctgctacaatggcgcatacaaagagaagcgacctcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtacc

SEQ ID NO: 11 - DNA, 687 bp, Enterobacter aerogenes
cgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttggcatccagagaacttagcagagatgctttggtgccttcgggaactctgagacaggtgctgcatggctgtcgtcagctcgtgttgtgaaatgttgggttaagtcccgcaacgggcgcaacccttatcctttgttgccagcggttaggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaac

SEQ ID NO: 12 - DNA, 531 bp, Enterobacter asburiae
cgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacagaacttggcagagatgccttggtgccttcgggaactgtgagacaggtgctgcatggctgtcgtcagctcgtgttgtgaaatgttgggttaagtcccgcaacgagcgcaacccctatcctttgttgccagcggtccggccgggaactcaaaggagactgccagtgataaactggaggaaggtggggatgacgtcaagtcatcatggcccttacgaccagggctacacacgtgctacaatggcgcacacaaagagaagcaatctcgcgagagctagcggacctcataaagcgcgtcgtagtccggattggagtctgcaactcgactccatgaagtcggaatcgttagtaatcg

SEQ ID NO: 13 - DNA, 686 bp, Enterobacter asburiae
cgacttggaggttgtgcccttgaggcgtggcttccggagctaacgcgtcaagtcgaccgcctggggagtacggccgcaaggttaaaactcaaatgaattgacgggggcccgcacaagcggtggagcatgtggtttaattcgatgcaacgcgaagaaccttacctggccttgacatccagagaacttagcagagatgctttggtgccttcgggaactctgagacaggtgctgcatggctgtcgtcagctcgtgttgtgaaatgttgggttaagtcccgcaacgagcacaacccttatcctttgttgccagcggtccggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagagtgctacggtgaatacgttcccgggccttgtacacaccgcccgtcacaccatgggagtgggttgcaatagaagtgtatagcttcggttagtgagggcgcaatccacgtcataactgctgactggagtgaagtcgtaacaaggtaac

SEQ ID NO: 14 - DNA, 687 bp, Enterobacter asburiae
cgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggcgccttcgggaactctgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtctttccaagatccc

SEQ ID NO: 15 - DNA, 686 bp, Enterobacter asburiae
cgacttggaggttgtgcccctgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacagaactttccagagatggattggtgccttcgggaactgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcaatctcgcgagagctagcggacctcataaagtgcgtcgtagtccggattggagtctgcaactcgactccatgaagtcggaatcgctagtaatcgtgaatcagaatgtcacggtgaatacgttcccgggccttgtacgcaccgcccgtcacaccataaagtgggttgcaaaagaagtaggtagcttaaccttcgggagggcgcttaccactttgtgattcatgactggggtgaagacgtaacaaggtaac

SEQ ID NO: 16 - DNA, 687 bp, Enterobacter asburiae
cgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacagaactttccagagatggattggtgccttcgggaactgtgagacaggtgctgcatggctgtcgtcagctcgtgctgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgaccagggctacacacgtgctacaatggcgcatacaaagagaagcaatctcgcgagagccagcggacctcataaagtgcgtcgtagtccggattggagtctgcaactcgactccatgaagtcggaatcgctagtaatcgtgaatcagaatgtcacggtgaatacgttcccgggccttgtacacaccgcccgtcacaccatgggagtgggttgcaaaagaagtaggtagcttaaccttcgggaggacgcttaccactttgtgattcatgactggggtgaagtcgtaacaaggtatc

SEQ ID NO: 17 - DNA, 687 bp, Enterobacter asburiae
cgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacagaactttccagagatggattggtgccttcgggaactgtgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgaccagggctacacacgtgctacaatggcgcatacaaagagaagcaatctcgcgagagccagcggacctcataaagtgcgtcgtagtccggattggagtctgcaactcgactccatgaagtcggaatcgctagtaatcgtgaatcagaatgtcacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtacc

SEQ ID NO: 18 - DNA, 512 bp, Enterobacter asburiae
attcagaacttggcagagatgccttggtgccttcgggaactgtgagacaggtgctgcatggctgtcgtcagctcgtgttgtgaaatgttgggttaagtcccgcaatgagcgcaacccttatcctttgttgccagcggttaggccgggaactcaaaggagaccgccagtgataaactggaggaaggtggggatgacgtcaagtcatcatggcccttacgaccagggctacacacgtgctacaatggcgcatacaaagagaagcaaactcgcgagagcaagcggacctcataaagtgcgtcgtagtccggattggagtctgcaactcgactccatgaagtcggaatcgctagtaatcgtgaatcagaatgtcacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaac

SEQ ID NO: 19 - DNA, 674 bp, Enterobacter asburiae
cgacttggaggttgtgcccttgaggcgtggcttccggagctaacgcgttaagtcgaccgcctggggagtacggccgcaaggttaaaactcaaatgaattggcgggggcccgcacaagcggtggagcatgtggtttaattcgatgcaacgcgaagaaccttacctggtcttgacatccacagaacttggcagagatgccttggtgccttcgggaactgtgagacaggtgctgcatggctgtcgtcagctcgtgttgtgaaatgttgggttaagtcccgcaacgagcgcaacccttatcctttgtcgccagcggttaggccgggaactcaaaggagactgccagtgataaactggaggaaggtggggatgacgtcaagtcatcatggcccttacgaccagggctacacacgtgctacaatggcgcatacaaagagtagcaatctcgcgagagccagcggacctcataaagtgcgtcgtagtccggattggagtctgcaactcgactccatgaagtcggaatcgctagtaatcgtgaatcagaatgtcacggtgaatacgttcccgggccttgtacacaccgcccgtcacaccatgggagtgggttgcaaaagaagtaggtagcttaaccttcgggagggcgcttaccactttgtgattcatgactggggtgaagtc

SEQ ID NO: 20 - DNA, 685 bp, Enterobacter asburiae
cgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacagaactcggcagagatgccttggtgccttcgggaactgtgagacaggtgctgcatggctgtcgtcagctcgtgttgtgaaatgttaggttaagtcccgcaacgagcgcaacccttatcctttgttgccagcggttaggccgggaactcaaaggagactgccagtgataaactggaggaaggtgggatgacgtcaagtcaccatggcccttacgaccagggctacacacgtgctacaatggcgcatacaaagagaagcaatctcgcgagagctagcggacctcataaagtgcgtcgtagtccggattgaagtctgcaactcgactccatgaagtcggaatcgctagtaatcgtgaatcagaatgtcacgttaatacgttcccgggccttgtacacaccgcccgtcacaccatgggagtgggttgcaaaagaagtaggtagcttaccttcgggagggcgcttaccacttttgtgattcatgactggggtgaagtcgtaacaaggtacc

SEQ ID NO: 21 - DNA, 687 bp, Enterobacter asburiae
cgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctggtcttgacatccacagaacttagcagagatgctttggtgccttcgggaactgtgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgaccagggctacacacgtgctacaatggcatatacaaagagaagcgacctcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaac

SEQ ID NO: 22 - DNA, 689 bp, Enterobacter cloacae
caactggatattggtctcactcggagatcagtgtcgaagctaacgcgttaagttcgccgcctggggagtacggtcgcaagactgaaactcaaaggaattgacgggggcccgcacaagcggtggagtatgtggtttaattcgatgcaacgcgaagaaccttacctggccttgacatgtccggaatcctgcagagatgcgggagtgccttcgggaatcggaacacaggtgctgcatggctgtcgtcagctcgtgtcgtgagatgttgggttaagtcccgcaacgagcgcaacccttgtccttagttgccagcgagtaaagtcgggaactctaaggagactgccggtgacaaaccggaggaaggtggggatgacgtcaagtcatcatggcccttacggccagggctacacacgtactacaatggtcggtacagagggttgcgataccgcgaggtggagctaatcccagaaagccgatcccagtccggattggagtctgcaactcgactccatgaagtcggaatcgctagtaatcgcagatcagctatgctgcggtgaatacgttcccgggccttgtacacaccgcccgtcacaccatgggagtgagctgctccagaagccgttagtctaaccgcaagggggacgacgaccacggagtgtttcatgactggggtgaagtcgtaacaaggtaac

SEQ ID NO: 23 - DNA, 691 bp, Enterobacter cloacae
gcgctggatgttgggtgacctagtcactcagtgtcgtagctaacgcgataagcgcaccgcctggggagtacggccgcaaggttgaaactcaaaggaattgacgggggcccgcacaagcggtggagcatgtggtttaattcaaagcaacgcgcagaaccttaccagctcttgacatgggtaggaccgacgcagagatgcgtttttcccgcaagggacctaccgcacaggtgctgcatggctgtcgtcagctcgtgtcgtgagatgttgggttaagtcccgcaacgagcgcaaccctcgcctttagttgccagcatgtttgggtgggcactctaaaggaactgccggtgacaagccggaggaaggtggggatgacgtcaagtcctcatggcccttatgggctgggctacacacgtgctacaatggcggtgacaatgggaagccaggcagcgatgtcgagccgatcccaaaaagccgtctcagttcagatcgcagcctgcaactcggctgcgtgaaggtggaatcgctagtaatcgcggatcagcacgccgcggtgaatacgttcccgggccttgtacacaccgcccgtcacaccatgggagttggttttaccttaagcaggtgcgctaacccgcaagggaggtagcttgccacggtaggatcagtgactggggtgaagtcgtaacaaggtaac

SEQ ID NO: 24 - DNA, 693 bp, Enterobacter ludwigii
gtgctaggtgttaggggtttcgatacccttggtgccgaagttaacacagtaagcactccgcctggggagtacggtcgcaagactgaaactcaaaggaattgacggggacccgcacaagcagtggagtatgtggtttaattcgaagcaacgcgaagaaccttaccaggtcttgacatccaactaacgaagcagagatgcatcaggtgcccttcggggaaagttgagacaggtggtgcatggttgtcgtcagctcgtgtcgtgagatgttgggttaagtcccgcaacgagcgcaacccttgactttagttgccagcaggtgaagctgggcactctagagtgactgccggtgacaaaccggaggaaggtggggatgacgtcaaatcatcatgccccttatgacctgggctacacacgtactacaatggccggtacaacgggaagcgaagccgcgaggcggagccaatcccagcaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaacccgcaagggagccagccgccgaaggtggggtagatgattggggtgaagtcgtaacaaggta

SEQ ID NO: 25 - DNA, 691 bp, Enterobacter sp.
atgctaggtgttgggggtttcaataccctcggtgccgaagttaacacattaagcatgccgcctggggagtacgctcgcaagagtgaaactcaaaggaattgacggggacccgcacaagcagtggagtatgtggtttaattcgaagcaacgcgaagaaccttaccaggtcttgacatcggaatgaccgcttcagagatggagctttccttcgggacattccagacaggtggtgcatggttgtcgtcagctcgtgtcgtgagatgttgggttaagtcccgcaacgagcgcaacccttgatcttagttgccagcatgtaaagatgggccctctaagatgactgccggtgacaaaccggaggaaggtagggatgacgtcaaatcatcatgccccttatgacctgggctacacacgtactacaatggccggtacaacggggagcgaaggagcgatctggagcaaatcctaataagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtgaggtaacccgcaagggagccagccgccgaaggtggggtagatgattggggtgaagtcgtaacaaggtacc

SEQ ID NO: 26 - DNA, 687 bp, Escherichia coli
cgacttggaggttgtgtccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaatttggcagagatgccttagtgccttcgggaaccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcatatacaaagagaagcgacctcgcgagagcaggcggacttcataaagtatgtcgtagtccggattggagtctgcaactcgactccatgaggtcggaatcgctagtaatcgtggatcagaatgccacggtgaatacgttcccgggccttgtacacaccgcccgtcgcaccatgggagtgggttgcaaaagaagtaggtagcttaaccttcgggagggcgcttaccactttgtgattcatgactggggtgaagtcgtaacaaggtacc

SEQ ID NO: 27 - DNA, 688 bp, Escherichia coli
cgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttaacatccacggaattcggcagagatgccttagtgccttcgggaaccgtgagacaggtgctgcatggctgtcgtcagctcgtgttgtgaaatgttgggttaagtcccgcaacgagcgcaacccttatcctttgctgccagcgagtaatgtcgggaactcaaaggagactgccggtgataaaccggaggaaggtggggatgacgtcaagtcatcatggcccttacgagtagggctacacacgtgctacaatggcgcatacaaagagaagcgacctcgcgagaaaaagcggacctcacaaagtgcgtcgtagtccggatcggagtctgcaactcgactccgtgaagtcggaatcgctagtaatcgtggatcagaatgccacgatgaatacgttcccgggccttgtacacaccgcccgtcacaccatgttgtgggttgcaaaagaagtaggtagcttaacccttcgggagggcgcttaccactttgtgattcatgactggagtgaagtcgtaacaaggtaac

SEQ ID NO: 28 - DNA, 688 bp, Escherichia coli
cgacttggaggttgttcccttgaggagtggcttccggagctaacgcgttaagtcgaccgcctggggagtacggccgcaaggttaaaactcaaatgaattgacgggggcccgcacaagcggtggggcatgtggtttaattcgatgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttgtcctttgttgccagcgagtcatgtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaagagaagtaggtagcttaaacttcgggagggcgcttaccactttgtgattcatgactggggtgaagtcgtaacaaggtatc

SEQ ID NO: 29 - DNA, 688 bp, Escherichia coli
cgacttggaggttgttcccttgaggagtggcttccggagctaacgcgttaagtcgaccgcctggggagtacggccgcaaggttaaaactcaaatgaattgacgggggcccgcacaagcggtggagcatgtggtttgattcgatgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgagtcatgtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaac

SEQ ID NO: 30 - DNA, 687 bp, Escherichia coli
cgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgacacggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcactcaccactttgtgattcatgactggggtgaagtcgtaacaaggtaga

SEQ ID NO: 31 - DNA, 687 bp, Escherichia coli
cgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgatacggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtatc

SEQ ID NO: 32 - DNA, 687 bp, Klebsiella pneumoniae
cgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgatacggtcgggaactcaaaggagactgccggtgataaaccggaggaaggtggggatgacgtcaagtcatcatggcccttacgagtagggctacacacgtgctacaatggcgcatacaaggagaagcgacctcgcgagagcaagcggacctcacaaagtgcgtcgtagtccggatcggagtctgcaactcgactccgtgaagtcggaatcgctagtaatcgtggatcagaatgccacggtgaatgcgttcccgggccttgtacacaccgcccgtcacaccatgggagtgggttgcaaaagaagtaggtagcttaaccttcgggagggcgcttaccactttgtgattcatgactggggtgaagtcgtaacaaggtacc

SEQ ID NO: 33 - DNA, 687 bp, Luteibacter sp.
cgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgatacggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagacgtaacaaggtacc

SEQ ID NO: 34 - DNA, 687 bp, Methylobacterium sp.
cgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtatc

SEQ ID NO: 35 - DNA, 686 bp, Paenibacillus caespitis
cgacttggaggttgtgcccttgaggcgcggcttccggagctaacgcgttaagtcgaccgtctggggagtacggtcgcaaggttaaaactcaaatgaattgacgggggcccgcacaagcggtggagcatgtggtttaattcgatgcaacgcggagaaccttacctggccttgacatccagagaacttagcagagatgctttggtgccttcgggaactctgagacaggtgctgcatggatgtcgtcagctcgtgttgtgaaatgttgggttaagtcccgcaacgagcgcaacccttatcctttgttgccagcgattcgttcgggaactcgaaggagactgccggtgacaaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattgaagtctgcaactcgactccatgaagtcggaatcgctagtactcttgaatcagaacctcacggtgaatacgttcccgggccttgtacacaccgcccgtcaccccatggagtggggtgctccacaagtagctagtctaaccctcggggagacggttaccacggagtgattcatgactggggtgaagtcgtaccaaggtaac

SEQ ID NO: 36 - DNA, 688 bp, Paenibacillus ruminocola
cgacttggaggttgttcccttgagaagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaattcggctgagatgcctcagtgccttcgggaaccgtgagacaggtgctgcatggctgtcgtcagctcgtgttgtgaaatgttgggttaagtcccgcaacgagcgcaacccttatcctttgttgccagcgagtcatgtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatggctggggtgaagtcgtaacaaggtaac

SEQ ID NO: 37 - DNA, 688 bp, Panteoa agglomerans
cgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcaatgcaacgcgaagaaccttacctactcttggcatccagcgaattcggcagagatgcctcagtgccttcgggaacgctgagacaggtgctgcatggctgtcgtcagctcgtgttgtgaaatgttgggttaagtcccgcaacgagcgcaacccttatcctttgttgccagcacgtaatggtgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggatctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaac

SEQ ID NO: 38 - DNA, 687 bp, Pantoea agglomerans
cgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaatgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccgggggaaggtggggatgacgtcaagtcatcatggcccttacgagtagggctacacacgtgctacaatggcgcatacaaagagaagcggcctcgcgagagtaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaac

SEQ ID NO: 39 - DNA, 687 bp, Pantoea agglomerans
cgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtacc

SEQ ID NO: 40 - DNA, 688 bp, Pantoea agglomerans
cgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagcgaacttggcagagatgccttggtgccttcgggaacgctgagacaggtgctgcgtggctgtcgtcagctcgtgttgtgaaatgttgggttaagtcccgcaacgagcgcaacccttatcctttgttgccagcgagtcatgtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtagc

SEQ ID NO: 41 - DNA, 687 bp, Pantoea agglomerans
cgacttggaggttgttcccttgaggagtggcttccggagctaacgcgttaagtcgaccgcctggggagtacggccgcaaggttaaaactcaaatgaattgacgggggcccgcacaagcggtggagcacgtggtttaattcgatgcaacgcgaagaaccttacctactcttgacatccagcgaacttggcagagatgccttggtgccttcgggaacgctgagacaggtgctgcatggctgtcgtcagctcgtgttgtgaaatgttgggttaagtcccgcaacgagcgcaacccttatcctttgttgccagcgagtcatgtcgggaactcaaaggagactgccggtgataaaccggaggaaggtggggatgacgtcaagtcatcatggcccttacgagtagggctacacacgtgctacaatggcgcatacaaagagaagcgacctcgcgagaacaagcggaccccacaaagtgcgtcgtagtccggatcgaagtctgcaactcgactccgtgaagtcggaatcgctagtaatcgtggatcagaatgccacggtgaacacgttcccgggccttgtacacaccgcccgtcacaccatgttgtgggttgcaaaagaagtaggtagcttaaccttcgggagggcgcttaccactttgtgattcatgactggagtgaagtcgtaacaaggtaac

SEQ ID NO: 42 - DNA, 687 bp, Pantoea agglomerans
cgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagcgaactttccagagatggattggtgccttcgggaacgctgagacaggtgctgcatggctgtcgtcagctcgtgttgtgaaatgttgggttaagtcccgcaacgagcgcaacccttatcctttgttgccagcgacacggtcgggaactcaaaggagactgccggtgataaaccggaggaaggtggggatgacgtcaagtcatcatggcccttacgagtagggctacacacgtgctacaatggcgcatacaaagagaagcgacctcgcgagaacaagcggacctcacaaagtgcgtcgtagtccggatcgaagtctgcaactcgactccgtgaagtcggaatcgctagtaatcgtggatcagaatgccacgatgaatacgctcccgggccttgtacacaccgcccgtcacaccatgttagtgggttgcaaaagaagtaggtagcttaaccttcgggagggcgcttaccactttgtgaatcatgactggagtgaagacgtaacaaggtaac

SEQ ID NO: 43 - DNA, 688 bp, Pantoea agglomerans
cgacttggaggttgttcccttgaggagtggcttccggagctaacgcgttaagtcgaccgcctggggagtacggccgcaaggttaaaactcaaatgaattgacgggggcccgcacaagcggtggagcatgcggtttaattcgatgcaacgcgaagaaccttacctactcttgacatccagcgaacttggcagagatgccttggtgccttcgggaacgctgagacaggtgctgcatggctgtcgtcagctcgtgttgtgaaatgttgggttaagtcccgcaacgagcgcaacccttatcctttgttgccagcgagtcatgtcgggaactcaaaggagactgccggtgataaaccggaggaaggtggggatggcgtcaagtcatcatggcccttacgagtagggctacacacgtgctacaatggcgcatacaaagagaagcgacctcgcgagagcaagcggacctcacaaagtgcgtcgtagtccggatcggagtctgcagctcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtatc

SEQ ID NO: 44 - DNA, 687 bp, Pantoea agglomerans
cgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtatc

SEQ ID NO: 45 - DNA, 687 bp, Pantoea agglomerans
cgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaac

SEQ ID NO: 46 - DNA, 687 bp, Pantoea agglomerans
cgacttggaggttgttcccttgaggagtggcttccggagctaacgcgttaagtcgaccgcctggggagtacggccgcaaggttaaaactcaaatgaattggcgggggcccgcacaagcggtggagcatgtggtttaattcgatgcaacgcgaagaaccttacctactcttgacatccagagaacttagcagagatgctttggtgccttcgggaactctgagacaggtgctacatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccctgtacacaccgcccgtcacaccatgggagtgggttgcaaaagaagtaggtagcctaaccttcgggggggcgcttaccactttgtgattcatgactggggtgaagtcgtaacaaggtacc

SEQ ID NO: 47 - DNA, 687 bp, Pantoea agglomerans; identical to SEQ ID NO: 45

SEQ ID NO: 48 - DNA, 687 bp, Pantoea agglomerans; identical to SEQ ID NO: 39

SEQ ID NO: 49 - DNA, 677 bp, Pantoea agglomerans
cgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaatgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccgggggaaggtggggatgacgtcaagtcatcatggcccttacgagtagggctacacacgtgctacaatggcgcatacaaagagaagcggcctcgcgagagtaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgta

SEQ ID NO: 50 - DNA, 687 bp, Pantoea agglomerans
cgacttggaggttgttcccttgaggagtagcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcgattcggtcgggaactcgaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgaccgatgactggggtgaagtcgtaacaaggtaac

SEQ ID NO: 51 - DNA, 688 bp, Pantoea agglomerans
cgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagcgaacttggcagagatgccttggtgccttcgggaacgctgagacaggtgctgcatggctgtcgtcagctcgtgttgtgaaatgttgggttaagtcccgcaacgtgcgcaacccttatcctttgttgccagcacgtcatggtgggaactcaaaggagaccgccggtgataaaccggaggaaggtggggatgacgtcaagtcatcatggcccttacgagtagggctacacacgtgctacaatggcgcatacaaagagaagcgacctcgcgagagcgagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaac

SEQ ID NO: 52 - DNA, 688 bp, Pantoea agglomerans
cgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagcgaacttggcagagatgccttggtgccttcgggaacgctgggacaggtgctgcatggctgtcgtcagctcgtgttgtgaaatgttgggttaagtcccgcaacgagcgcaacccttatcctttgttgccagcgagtcatgtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaacttgactccgtgaagtcggaatcgctagtaatcgtggatcagaatgtcacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtatc

SEQ ID NO: 53 - DNA, 688 bp, Pantoea agglomerans
cgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaattcggcagagatgccttagtgccttcgggaaccgtgagacaggtgctgcatggctgtcgtcagctcgtgttgagaaatgttgggttaagtcccgcaacgagcgcaacccttatcctttgttgccagcgagtcatgtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatctgaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtacc

SEQ ID NO: 54 - DNA, 665 bp, Pantoea agglomerans
cgacttgaaggttgtgcccttgaggagctgtttcctgactaacgcgttaagtcgaccgcctggggagtacggccgcaaggttaaaactcaaatgaattggcgggggcccgcacaagcggtggagcatgtggtttaattcgatgcaacggaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgatacggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactgggg

SEQ ID NO: 55 - DNA, 687 bp, Pantoea agglomerans
cgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaacctcacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgatacggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgcgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaac

SEQ ID NO: 56 - DNA, 684 bp, Pantoea agglomerans
cgacttggaggttgttcccttgaggagtggcttccgggactaacgcgttaagtcgaccgcctggggagtacggccgcaaggttaaaactcaaatgaattgacgggggccgcacaagcggtggagcatgtggtttaattcgatgcaacgcgaagaaccttacctactcttgacatccacggaattcggcagagatgccttagtggcttcgggaaccgtgagacaggtgctgcatggctgtcgtcagctcgtgttgtgaaatgttgggttaagtcccgcaacgagcgcaacccttatcctttgttgccagcgacacggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgatccgtgaagtcggaatcgctagtaatcgtggatcagaatgccacggtgaatacgttcccgggccttgtacacaccgcccgtcacaccatgggagtgggttgcaaaagaagtaggtagcttaacttcgggagggcgcttaccactttgtgattcatgactggggtgaagtcgtaacaaggtacc

SEQ ID NO: 57 - DNA, 666 bp, Pantoea agglomerans
cgacttgaaggttgtgcccttgaggcgtgtgttccggggctaacgcgttaagtcgaccgcctggggagtacggccgcaaggttaaaactcaaatgaattgacgggggcccgcacaagcggtggagcatgtggtttagttcgatgcaacggaagaaccttacctactcttgacatccacggaattcggcagagatgcctcagtgccttcgggaaccgtgagacaggtgctgcatggctgtcgtcggctcgtgttgtgaaatgttgggttaagtcccgcaacgagcgcaacccttatcctttgttgccagcgacacggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagggcgtcgtagtccggatcggagtctgcaactcgactccgtgaagtcggaatcgctagtaatcgtggatcagaatgccacggtgaatacgttcccgggccttgtacacaccgcccgtcacaccatggagtgggttgcaaaagaagtagggagcttaaccttcgggagggcccttaccactttgggattcttgactggggg

SEQ ID NO: 58 - DNA, 688 bp, Pantoea agglomerans
cgacttggaggttgttcccttgaggagtggcttccggagctaacgcgttaagtcgaccgcctggggagtacggccgcaaggttaaaactcaaatgaattgacgggggcccgcacaagcggtggagcgtgtggtttaattcgatgcaacgcgaagaaccttacctactcttgacatccagcgaacttggcagagatgccttggtgccttcgggaacgctgagacaggtgctgcatggctgtcgtcagctcgtgttgtgaaatgttgggttaagtcccgcaacgagcgcaacccttatcctttgttgccagcgagtcatgtcgggaactcaaaggagactgccggtgataaaccggaggaaggtgggggtgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccgctttgtgattcatgactggggtgaagtcgtaacatggtacc

SEQ ID NO: 59 - DNA, 690 bp, Pantoea agglomerans
cgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactctcgacatccagcgaacttggcagagatgccttggtgccttcgggaacgctgagacaggtgctgcatggctgtcgtcagctcgtgctgtgaaatgttgggttaagtcccgcaacgagcgcaacccttatcctttgttgccagcacgtcatgttggtaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgcctcggtgaatacgtttcccgggccttgtacacaccgcccgtcacaccatggagtgggttgcaaaagaagtaggtagcttaaccttcgggagggcgctttaccactttgtgattcgggactggggtggaagtcgtaatcaaggacc

SEQ ID NO: 60 - DNA, 688 bp, Pantoea agglomerans
cgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagcgaacttggcagagatgccctggtgccttcgggaacgctgagacaggtgctgcatggctgtcgtcagctcgtgttgtgaaatgttgggttaagtcccgcaacgagcgcaacccttatcctttgttgccagcacgtcatggtgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgagaagtcggaatcgctagtaatcgtggatcggaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtacc

SEQ ID NO: 61 - DNA, 687 bp, Pantoea agglomerans; identical to SEQ ID NO: 34

SEQ ID NO: 62 - DNA, 687 bp, Pantoea agglomerans
cgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcgattcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaac

SEQ ID NO: 63 - DNA, 686 bp, Pantoea agglomerans
cgacttggaggttgttcccttgaggagtggcttccggagctaacgcgttaagtcgaccgcccggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtac

SEQ ID NO: 64 - DNA, 687 bp, Pantoea agglomerans
cgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgacacggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtagc

SEQ ID NO: 65 - DNA, 688 bp, Pantoea agglomerans
cgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgttgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctctgttgccagcgagtcatgtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggggtgggttgcaaaagaggtaggtagcttaaccttcgggagggcgcttaccactttgtgattcatgactggggtgaagtcgtaacaaggtacc

SEQ ID NO: 66 - DNA, 629 bp, Pantoea agglomerans
ccgcctggggagtacggtcgcaagaccgaaactcaaaggaattgacaggggcccgcacaagcggtggagcatgtggtttaattcgatgcaacgcgaagaaccttacctactcttgacatccacggaattcggcagagatgccttagtgccttcgggaaccgtgagacaggtgctgcgtggctgtcgtcagctcgtgttgtgaaatgttgggttaagtcccgcaacgagcgcaacccttatcctttgttgccagcgagtcatgtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaaatacgtttcccgggccttgtacacaccgcccgtcacaccatgggagttggttgcaaaagaagtaggtagcttaaccttcgggagggcgcttaccactttgtgattcatgactggggtgaagtcgtaacaag

SEQ ID NO: 67 - DNA, 687 bp, Pantoea agglomerans
cgacttggaggttgttcccttgaggagtggcttccggagctaacgcgttaagtcgaccgcctggggagtacggccgcaaggttaaaactcaaatgaattgacgggggcccgcacaagcggtggaacgtgtggtttaattcgatgcaacgcgaagaaccttacctactcttgacatccacggaactcggcagagatgccttagtgccttcgggaaccgtgagacaggtgctgcatggctgtcgtcagctcgtgttgtgaaatgttgggttaagtcccgcaacgagcgcaacccttatcctttgttgccagcacgtcatggtgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggactcacaaagtgcgtcgtagtccggatcggagtctgcaactcgactccgtgaagtcggaatcgctagtaatcgtggatcagaatgccacggtgaatacgtccccgggccttgtacacaccgcccgtcacaccatgggagtgggttgcaaaagaagtaggtagcttaaccttcgggagggcgcttaccactttgtgattcatgactggggtgaagtcgtaacaaggtatc

SEQ ID NO: 68 - DNA, 688 bp, Pantoea agglomerans
cgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgtcgccagcgagtcatgtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggagaagtcgtaacaaggtatc

SEQ ID NO: 69 - DNA, 687 bp, Pantoea agglomerans
cgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtatc

SEQ ID NO: 70 - DNA, 687 bp, Pantoea agglomerans
cgacttggaggttgttcccttgaggagtggcttcccgagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtatc

SEQ ID NO: 71 - DNA, 687 bp, Pantoea agglomerans; identical to SEQ ID NO: 45

SEQ ID NO: 72 - DNA, 687 bp, Pantoea agglomerans; identical to SEQ ID NO: 44

SEQ ID NO: 73 - DNA, 687 bp, Pantoea agglomerans; identical to SEQ ID NO: 46

SEQ ID NO: 74 - DNA, 687 bp, Pantoea agglomerans; identical to SEQ ID NO: 70

SEQ ID NO: 75 - DNA, 687 bp, Pantoea agglomerans
cgacttggaggttgttcccttgaggagtggcttccggagctaacgcgataagtcgaccgcctggggagtacggccgcaaggttaaatctcaaatgaattgacgggggcccgcacaagcggtggagcatgtggtttaattagatgcaacgagaagaaccttacgtactcttgacatccagagaacttagcagagatgctttggtgctttcgggatctatgagacaggtgccgcatggctgttgtcagctcgtgttgtgaaatgttgggttaagtcccgcaacgagcgcaacccttatcctttgttcccagcgattcggtcgggaattcaaaggagactgccggtgataaaccggaggaaggtggggaggacgtcaagtcatcatggcccttacgagtagggctccccacgtgttccaatggagcatccaaagagaagcgacctcgcgagagtaagcggtcctcgcaaagtgcgtcctcgtccggatcggattctgcaattggactccgggaattcggaatcgttagcaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaac

SEQ ID NO: 76 - DNA, 687 bp, Pantoea agglomerans
cgacttggaggttgttcccttgaggagtggcttccggagctaacgcgttaagtcgaccgcctggggagtacggccgcaagcctaaaactcaaatgaattgacgggtgcccgcacaagcgatggagcatgtggtttaattcgatgcaacgctaagaaccttacctactcttgacatccagagaacttagcagagatgctttggtgccttcgggaactctgagacaggtgctgcatggatgtcgtcagcccgggttgtgaaatgttgggttaggtcccgcaacgagcgcaacccttatcctttgttgccagcgattcgttcgggaactcgaaggagactgccggtgataaaccgaaggaagggggggatgacgtcaagtcatcatggcccttacggccagggctacacacgtgctacaatggcgcatacaaagagaagcgacctcgcgagagcaagcggacctcataaagtgcgtcgtagtccggatcgaagtctgcaactcgactccgtgaagtcggaatcgctagtactcgtggatcagaatgccacgttaatacgttcccgggccttgtacacaccgccccgtcacaccatgagagtgcgttgcaaaagaagtaggtagcttaaccttcaggaggccgcttaccactttgtgattcatgactggagcgaagtcgtaacaaggtacc

SEQ ID NO: 77 - DNA, 687 bp, Pantoea agglomerans
cgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtacc

SEQ ID NO: 78 - DNA, 688 bp, Pantoea agglomerans
cgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaacccttcgggagggcgcttaccactttgtgattcatgaccggggtgaagtcgtaacaaggtacc

SEQ ID NO: 79 - DNA, 674 bp, Pantoea agglomerans
cgacttggaggttgttcccttgaggagtggcttccggagctaacgcgttaagtcgaccgcctggggagtacggccgcaaggttaaaactcgaatgaattgacgggggcccgcacaagcggtggagcatgtggtttaattcgatgcaacgcgaagaaccttacctactcttgacatccagagaacttagcagagatgctttggtgccttcgggagctctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtc

SEQ ID NO: 80 - DNA, 687 bp, Pantoea agglomerans
cgacttggaggttgttcccttgaggagtggcttccggagctaacgcgttaagtcgaccgcctggggagtacggccgcaaggttaaaactcaaatgaattgacgggggcccgcacaagcggtggagcatgcggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcacatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgaccgatgactggggtgaagtcgtaacaaggtaac

SEQ ID NO: 81 - DNA, 687 bp, Pantoea agglomerans
cgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctggaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtacc

SEQ ID NO: 82 - DNA, 685 bp, Pantoea agglomerans
cgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaatttggcagagatgccttagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtccgcaactcgactccgtgaagtcggaatcgctagtaatcgcggatcagaatgccacggtgaatacgttcccgggccttgtacacaccgcccgtcacaccatggagtgggttgcaaaagaagtaggtagcttaaccttcgggagggcgcttaccactttgtgattcatgactgggtgaagtcgtaacaaggtacc

SEQ ID NO: 83 - DNA, 687 bp, Pantoea agglomerans
cgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaac

SEQ ID NO: 84 - DNA, 687 bp, Pantoea agglomerans; identical to SEQ ID NO: 81

SEQ ID NO: 85 - DNA, 686 bp, Pantoea agglomerans
cgacttggaggttgttcccttgaggagtggcttccggagctaacgcgttaagtcgaccgcctggggagtacggccgcaagcctaaaactcaaatgaattgacgggtgcccgcacaagcgatggagcatgtggattaattcgatgcgacgtgaagaaccttacctactcttgacatccagagaacttagcagagatgctttggtgccttcgggaactctgagacaggtgctgcatggatgtcgtcagctcgtgttgtgaaatgttgggttaagtcccgcaacgagcgcaacccttatcctttgttgcgagcgattcgttcgggaactcgaaggagactgccggtgataaaccgaaggaaggtggggatgacgtcaagtcatcatggcccttacgagtagggctacacacgtgctacaatggcgcatacaaagagaagcgacctcgcgagagtaagcggacctcactaagtgcgtcgtagtccggatcggagtctgcaactcgactccgtgaagtcggaatcgctagcaatcgtggatcagaatgccacgttgaatacgttcccgggccttgtacacaccgcccgtcacaccatggagtgcgttgcaaaacaagaaggtagcttaaccttcaggaggtcgcttaccactttgtgattcatgactggggcgaggtcgtaacaagggacc

SEQ ID NO: 86 - DNA, 687 bp, Pantoea agglomerans
cgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttggcatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaac

SEQ ID NO: 87 - DNA, 690 bp, Pantoea ananatis
cgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcctgacatccagcgaactttccagagatggattggtgccttcgggaacgctgagacaggtgctgcatggctgtcgtcagctcgtgttgtgaaatgttgggttaagtcccgcaacgagcgcaacccttatcctttgttgccagcgagtcatgtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagttgggttgcaaaagaagtaggtagcttaaccttcgggagggcgcttaccactttgtgatttcatgactggggtgaagtcgtaacaaggtacc

SEQ ID NO: 88 - DNA, 686 bp, Pantoea ananatis
cgacttggaggttgttcccttgaggagtggcttccggagctaacgcgttaagtcgaccgcctggggagtacggccgcaaggctaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcggagggcgcttaccactttgtgattcatgactggggtgaagtcgtaacaaggtacc

SEQ ID NO: 89 - DNA, 687 bp, Pantoea ananatis
cgacttggaggttgttcccttgaggagtggcttccggagctaacgcgttaagtcgaccgcccggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtacc

SEQ ID NO: 90 - DNA, 687 bp, Pantoea ananatis
cgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcgattcggtcgggaactcaagggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaacccgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtacc

SEQ ID NO: 91 - DNA, 688 bp, Pantoea ananatis
cgacttggaggttgttcccttgaggagtggcttccggagctaacgcgttaagtcgaccgcctggggagtacggccgcaaggttaaaactcaaatgaattgacgggggcccgcacaagcggtggagcatgtggttttaattcgatgcaacgcgaagaaccttacctactcttgacatccagagaactttccagagatggattggtgccttcgggaactctgagacaggtgctgtatggctgtcgtcagctcgtgttgtgaaatgttgggttaagtcccgcaacgagcgcaacccttatcctttgttgccagcgattcggtcgggaactcaaaggagactgccggtgataaaccggaggaaggtggagatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccacttcgtgattcatgactggggtgaagtcgtaacaaggtaac

SEQ ID NO: 92 - DNA, 687 bp, Pantoea ananatis; identical to SEQ ID NO: 89

SEQ ID NO: 93 - DNA, 687 bp, Pantoea ananatis; identical to SEQ ID NO: 90

SEQ ID NO: 94 - DNA, 687 bp, Pantoea ananatis
cgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtacc

SEQ ID NO: 95 - DNA, 687 bp, Pantoea ananatis
cgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaaaaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtacc

SEQ ID NO: 96 - DNA, 686 bp, Pantoea ananatis
cgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgcctccgggaactctgagacaggtgctgcatggctgtcgtcagctcgtgttgtgaaatgttgggttaagttccgcaacgagcgcaacccttttcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagggcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcggagggcgcttgccactttgtgattcatgactggggtgaagtcgtaacaaggtacc

SEQ ID NO: 97 - DNA, 687 bp, Pantoea ananatis
caactagccgttggaagccttgagcttttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatggactttccagagatggattggtgccttcgggaacattgagacaggtgctgcatggctgtcgtcagctcgtgtcgtgagatgttgggttaagtcccgtaacgagcgcaacccttgtccttagttaccagcacgtgatggtggcactctaaggagactgccggtgacaaaccggaggaaggtggggatgacgtcaagtcatcatggcccttacggcctgggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtggatcagaatgccacggtgaatacgttcccgggccttgtacacaccgcccgtcacaccatgggagtgggttgcaaaagaagtaggtagcttaaccttcaggagggcgcttaccactttgtgattcatgactggggtgaagtcgtaacaaggtatc

SEQ ID NO: 98 - DNA, 688 bp, Pantoea sp.
caactagccgttgggatccttgagatcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacataatggtgggcactctaaggagactgccggtgacaaaccggaggaaggtggggatgacgtcatgtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctagccttcgggaggacggttaccacggagtgaccgatgactggggtgaagtcgtaacaaggtaac

SEQ ID NO: 99 - DNA, 688 bp, Pantoea sp.
caactagccgttgggatccttgagatcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgttatggtgggcactctaaagagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccctcgggaggacggttaccacggagtgattcatgactggggtgaagtcgtaacaaggtaac

SEQ ID NO: 100 - DNA, 690 bp, Pantoea sp.
cgaactggatgttgggagcaatttggcacgcagtatcgaagctaacgcgttaagttcgccgcctggggagtacggtcgcaagactgaaactcaaaggaattgacggggggctgcacaagcggtggagtatgtggtttaattcgatgcaacgcgaagaacctttcctggccttgacatgtcgagaactttccagagatggattggtgccttcgggaactcgaacacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacggccagggctacacacgtactacaatggtagggacagagggctgcaagccggcgacggtaagccaatcccagaaaccctatctcagtccggattggagtttgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgctgtcacggtgtggccgatgactggggtgaagtcgtaacaaggtaac

SEQ ID NO: 101 - DNA, 688 bp, Pantoea sp.
cgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgacgcaacgcgaagaaccttacctggccttgacatgtcgagaactttccagagatggattggtgccttcgggaactcgaacacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacggccagggctacacacgtactacaatggtagggacagagggctgcaagcgggcgacggtaagccaatcccagaaaccctatctcagtccgaattggagtctgcaactcgactccatgaagtcggaatcgctagcaatcgcagatcagcattgctgcgatgaatacgttcccgggccttgtacacaccgcccgtcacaccatgggagtttgttgcaccagaagcaggtagcttaaccttcgggaggccgctcgccacggtgtggtcgatgactgggtgaagtcgtaacaaggtacc

SEQ ID NO: 102 - DNA, 688 bp, Pantoea sp.
agaagtgaggttgggtgcgatttggcacgcagtttcgaagctaacgcgttaagttcgccgcgtgggggagtacggtcgcaaggctgaaactcaaaggaattgacgggggtccgcacaagcggtggagtatgtggtttaattcgatgcaacgcgaagaaccttacctggccctgacatgtcgagaactttccagagatggttggtgccttcgggaactcgaacacaggtgctgcatggctgtcgtcagctcgtgtcgtgagatgttgggttaagtcccgcaacgagtgcaacccttgtccttagttgccggcacgtaatggtgggaactctaaggagaccgccggtgacaaaccggaggaaggtggggatgacgtcaggtcatcatggcccttacggccagggctacgcgcgtactacaatggtagggacagagggttgcaagccggcgacggtaagtcaatcccagaaaccctatctcagtccggattggagtctgcaactcgactccatgaagtcggaatcgttagtaatcgcagatcagcattgctgcggtgaatacgttcccgggccttgtacacaccgcccgtcacgccatgggagtttgttgcaccagaagcaggtagctcaccttcgcgagggcgctttccacggtgtggccgatgactggggtgaagtcgtaacaaggtcc

SEQ ID NO: 103 - DNA, 691 bp, Pantoea sp.
  modified_base (330)..(330): a, c, t or g
cgaactggatgttgggtgcaatttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggccttgacatgtcgagaactttccagagatggattggtgccttcgggaactcgaacacaggtgctgcatggctgtcgccagctcgtgtcgtgagatgttgggttaagttccgcaacgagcgcaacccttgtccttagttgccagcacgtaatggtgggaactntaaggagaccgccggtgacaaaccggaggaaggtggggatgacgtcaagtcatcatggcccttacggccagggctacacacgtactacaatggtagggacagagggctgcaagccggcgacggtaagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgcttgccacggtgtggccgatgactggggtgaagtcgtaacaaggtacc

SEQ ID NO: 104 - DNA, 690 bp, Pantoea sp.
cgaactggatgttgggtgcaatttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggccttgacatgtcgagaactttccagagatggattggtgccttcgggaactcgaacacaggtgctgcatggctgtcgccagctcgtgtcgtgagatgttgggttaagttccgcaacgagcgcaacccttgtccttagttgccagcacgtaatggtgggaactttaaggagaccgccggtgacaaaccggaggaaggtggggatgacgtcaagtcatcatggcccttacggccagggctacacacgtactacaatggtagggacagagggctgcaagccggcgacggtaagccaatcccagaaaccctatctcagtccggattggagtttgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgcttgccacggtgtggccgatgactggggtgaagtcgtaacaaggtac

SEQ ID NO: 105 - DNA, 691 bp, Pantoea sp.
cgaactgaatgttgggtgcgatttggcacgcagcatcgaggctaacgcgttaagttcgccgcctggggagtacggacgccagcctgaaactcatacgaattgacgagggcccgcacgagcgattgaggatgtggattaattcgatgcaacgagaagaatcttatctggccttgacatgtcgagaactttccagatatggattggtgccttcgggaactcgaacacaggtgctgcatgaatgtcgtcagctctggtcgtgagatgctggcttaagtcccgcaacgagcgcaacccttgtccttagttgcgagcacgtcatgagggtaactctaaggagaccgcgggtgacaaaccgaaggaaggtgcggatgacgtcaagtcatcatggcccttacggccagggctacacacgtcctacaatgataggtacacaggtccgcaagcgggcgacgctaagccaatcaaggaaaccatatctcagtccggattgaagtccgcaactcgactccatgaagtccgaatcactagaactctcagatcagcatcgctgcggtgcatacattcccggtccttggacacaccgcccgtcacgccatggtaatttggtgtaccacaagcaggtagcttaaccttcgggagggcgcttgctacgatgtgtcggaggactggggcgcagtcgtaacaaggcacc

SEQ ID NO: 106 - DNA, 690 bp, Pantoea sp.
cgaactggatgttgggtgcaatttggcacgcagcatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggccttgacatgtcgagaactttccagagatggattggtgccttcgggaactcgaacacaggtgctgcatggctgtcgtcagctcgtgtcgtgagatgttggcttaagtcccgcaacgagcgcaacccttgtccttagttgccagcacgtaatggtgggaactctaaggagaccgccggtgacaaaccggaggaaggtggggatgacgtcaagtcatcatggcccttacggccagggctacacacgtactacaatggtagggacagagggctgcaagccggcgacggtaagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatggagtttgttgcaccagaagcaggtagcttaaccttcgggagggcgcttgctacggtgtggccgatgactggggtgaagtcgtaacaaggtaac

SEQ ID NO: 107 - DNA, 690 bp, Pantoea sp.
cgaactggatgttgggtgcaatttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggccttgacatgtcgagaactttccagagatggattggtgccttcgggaactcgaacacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacggccagggctacacacgtactacaatggtagggacagagggctgcaagccggcgacggtaagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgcttgccacggtgtgccgatgactggggtgaagtcgtaacaaggtatc

SEQ ID NO: 108 - DNA, 691 bp, Pseudomonas fluorescens
cgaactggatgttgggtgcaatttggcacgcagtatcgaagctaacgcgttaagttcgccgcctggggagtacggtcgcaagactgaaactcaaaggaattgacggggggccgcacaagcggtggagtatgtggtttaattcgatgcaacgcgaagaaccttacctggccttgacatgtcgagaactttccagagatggattggtgccttcgggaactcgaacacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacggccagggctacacacgtactacaatggtagggacagagggctgcaagccggcgacggtaagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgcttgccacggtgtggccgatgactggggtgaagtcgtaacaaggtacc

SEQ ID NO: 109 - DNA, 691 bp, Pseudomonas oleovarans
cgaactggatgttgggtgcaatttggcacgcagtatcaaagccaacgcgttaagttcgccgcctggggagtacggtcgcaagactgaaactcaaaggaattgacgggggcccgcacaagcggtggagtatgtggtttaattcgatgcaacgcgaagaaccttacctggccttgacatgtcgagaactttccagagatggattggtgccttcgggaactcgaacacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacggccagggctacacacgtactacaatggtagggacagagggctgcaagccggcgacggtaagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgcttgccacggtgtggccgatgactggggtgaagtcgtaacaaggtatc

SEQ ID NO: 110 - DNA, 691 bp, Pseudomonas oryzihabitans
cgaactggatgttgggtgcaatttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggccttgacatgtcgagaactttccagagatggattggtgccttcgggaactcgaacacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacggccagggctacacacgtactacaatggtagggacagagggctgcaagccggcgatggtaagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgcttgccacggtgtgcccgatgactggggtgaagtcgtaacaaggtacc

SEQ ID NO: 111 - DNA, 691 bp, Strenotrophomonas maltophilia
cgaactggatgttgggtgcaatttggcacgcagtatcgaagctaacgcgttaagttcgccgcctggggagtacggtcgcaaggctgaaactcaaaggaattgactggggcccgcacaagcggtggagtatgtggtttaattcgatgcaacgcgaagaaccttacctggccttgacatgtcgagaactttccagagatggattggtgccttcgggaactcgaacacaggtgctgcatggctgtcgtcagctcgtgtcgtgagatgttgggttaagtcccgcaacgagcgcaacccttgtccttagttgccagcacgtaatggtgggaactctaaggagaccgccggtggcaaaccggaggaaggtggggatgacgtcaagtcatcatggcccttacggccagggctacacacgtactacaatggtagggacagagggctgcaagccggcgacggtaagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgcttgccacggtgtggccgatgactggggtgaagtcgtaacaaggtatc

SEQ ID NO: 112 - DNA, 691 bp, Strenotrophomonas maltophilia
cgaactggatgttgggtgcaatttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggccttgacatgtcgagaactttccagagatggattggtgccttcgggaactcgaacacaggtgctgcatggctgtcgccagctcgtgtcgtgagatgttgggttaagttccgcaacgagcgcaacccttgtccttagttgccagcacgtaatggtgggaactctaaggagaccgccggtgacaaaccggaggaaggtggggatgacgtcaagtcatcatggcccttacggccagggctacacacgtactacaatggtagggacagagggctgcaagccggcgacggtaagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgcttgccacggtgtggccgatgactggggtgaagtcgtaacaaggtacc

SEQ ID NO: 113 - DNA, 689 bp, Strenotrophomonas maltophilia
cgaactggatgttgggtgcaatttggcacgcagtatcgaagctaacgcgttaagttcgccgcctggggagtacggtcgcaagactgaaactcaaaggaattgacgggggcccgcacaagcggtggagtatgtggtttaattcgacgcaacgggaagaaccttacctggccttgacatgtcgagaactttccagagatggattggtgccttcgggaactcgaacacaggtgctgcatggctgtcgtcagctcgggtcgtgagatgttgggttaagtcccgcaacgagcgcaacccttgtccttagttgccagcacgtcatgggggtaactctaaggagaccgcgggtgacaaaccgaagaaaggggcggatgacgtcaagtcatcatggcccttacggccagggctacacacgtcctacaatggtaggtacagagggctgcaagccggcgacgctaagccaatcaaagaaaccctatctcagtccggattgaagtctgcaactcgactccatgaagtcggaatcgctagaactcgcagatcagcattcgctgcggtgaatacgttcccggtcctggtacacaccgcccgtcacaccatggaagtttgttgcaccagaagaaggtagcttaaccttcggggagggcgcttgccacggtgtggcgaggactggggagagtcgtaccaggtat

SEQ ID NO: 114 - DNA, 691 bp, Strenotrophomonas maltophilia
cgaactggatgttgggtgcaatttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggccttgacatgtcgagaactttccagagatggattggtgccttcgggaactcgaacacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacggccagggctacacacgtactacaatggtagggacagagggctgcaagccggcgacggtaagccaatcccagaaaccctatctcagtccggattggagcctgcaacttgactccatgaagtcggaatcgctagtaatcgcagatcagcattgctgcggtgaatacgttcccgggccttgtacacaccgcccgtcacaccatgggagtttgttgcaccagaagcaggtagcttgaccttcgggagggcgcttgccacggtgtggccgatgactggggtgaagtcgtaacaaggtacc

SEQ ID NO: 115 - DNA, 691 bp, Strenotrophomonas maltophilia
cgaactggatgttgggtgcaatttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggccttgacatgtcgagaactttccagagatggattggtgccttcgggaactcgaacacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatggcgtcaagtcatcatggcccttacggccagggctacacacgtactacaatggtagggacagagggctgcaagccggcgacggtaagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccataggagtttgttgcaccagaagcaggtagcttaaccttcgggagggcgcttgccacggtgtggccgatgactggggtgaagtcgtaacaaggtacc

SEQ ID NO: 116 - DNA, 683 bp, Strenotrophomonas maltophilia
cagctgattgttcgggaagcaattcctgggtaaccaagccaacgcgtgaagctgaccgcctgggaagtacggtcgcaagattaaaactcaaaggaattgacggggacccgcacaagcggtggatgatgtggattaattcgacgcaacgcgaaaaaccttacctagccttgacatgtcaggaacccggatgaaagtctggagtgcccgcaagggagcctgaacacaggtgctgcatggctgtcgtcagctcgtgtcgtgagatgttgggctaagtcccgcaacgagcgcaaccctagtcatcagttgctacgcaagagcactctgatgagaccgccggtgacaaaccggaggaagatggggatgacgtcaagtcctcatggcccttacggctaggacctcacacgtcatataatggtcggaacagagggcagcgaagccgggaggcggagctaatcccagaaaaccgatcgtagtccggattgcagtctgcaactcgactgcatgaagtcggaatcgctagtaatcgcggatcagcatgccgcggtgaatacgtttcccggttcttgtacacaccgcccgtcacaccatgggagtggggtttgccagaaggcgtttgtccaaccgcaaggaggacggcgaccacggtgggttcaatgactggggcgaagtcgtaacaaggtatc

SEQ ID NO: 117 - DNA, 657 bp, Strenotrophomonas maltophilia
ggatttggggagtatcgaccctctccgagtcgaagctaacgcgttaagcgatccgcctgggtagtacggccgcaaggataaaactcaaaggaatagacggggacttgcacaagcggtggagcgtgtggcttaattcgtcgctaaccgaagaaccttaccaaggctagaaatgctactgcacgcccagcgaaagctgggaagccttcgagggtgtagcacaggtgatgcacggctgtcgtcagttcgtggtttgaatcgttcccttcagtggggtaacgaacgcaaccctcgttgcctgttatatatgtcaggcgagactgccccctcacgggggaggaaggtgaggatgacgccaagtcagcgtgtccctctgatgtcttgagctgcacacgcgctacaatcgccgttacaaaggggcgcaatggggtaacccggagcaaatcccaaaaagcggcgccggttcggattgaggtctgcaacccgacctcatgaagccggaatcgctagtaatcgtgggtcagccacaccacggtgaatacgttctcaagtcttgtactcacagcccgtcaactcaggaaagttggaagtgcccgaagtcaatcctcgtgattgcccaaggcaaactcaataacaaagagtaagtcgtaacaaggtaac

SEQ ID NO: 118 - DNA, 656 bp, Strenotrophomonas maltophilia
cttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaattctgcagagatgccttagtgccttcgggaaccgtgagacaggtgctgcatggctgtcgtcagctcgtgttgtgaaatgttgggttaagtcccgcaacgagcgcaacccttatcctttgttgccagcgatacggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtc

SEQ ID NO: 119 - DNA, 658 bp, Strenotrophomonas maltophilia
tccccgggatctgtgccgtagctaacgcattaagcgccccgcctgggagtacggccgcaaggttaaactcaaaggaattgacgggggcccgcacaagcgcggagatgtggattaattcgatgcaacgcgaagaaccttacctggttttgacatacaccggaaaaccgtagagatacggccccccttgtggccggtgtacaggtggggcatgtttgtcgtcagctcgggtcgggagatgttgggttaggtcccgcaacgagcgcaacccttgtcttatgttgccagcacgtaatgttggggactcgtaagagattgccgggttcaactcgaaggaaggtggggacgacgtcaagtcatcttgccccttatgtccagggcttcacacatgctacaatggccagtacagagggctgcgagaccgtggaggggaagcgaatcccttaaagctggtctcagttcggatcggggtctgcaactcgaccccgtgaagtcggagtcgctagtaatcgcagatcagcaacgctgcggtgaatacgttcccgggccttgtacacaccgccccgtcacgtcatgaaagtcgtaacacccgaagccgggtggcctaaccccttgtgggagggagccgtcgaaaggtggtatcggcgattgggacgaatct

SEQ ID NO: 120 - DNA, 654 bp, Strenotrophomonas maltophilia
tgagatcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccctcgggaggacggttaccacggagtgattcatgactggggtgaagt

SEQ ID NO: 121 - DNA, 656 bp, Strenotrophomonas maltophilia
cttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgatacggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtc

SEQ ID NO: 122 - DNA, 652 bp, Strenotrophomonas maltophilia
actgagggtggattccggagctaacgcgttaagtcgaccgcctggggagtacggccgcaagttaaaactcaaatgaattgacgggggcccgcacaaggagggagcatgtggtttaattcgatgcaacggaagaaccttacctggtcttgacatccacagaacttggcagagatgccttggtgccttcgggaactgtgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgaccagggctacacacgtgctacaatggcgcatacaaagagaagcaatctcgcgagacctagcggacctcataaagtgcgtcgtagtccggattggagtctgcaactcgactccatgaagtcggaatcgctagtaatcgtgaatcagaatgtcacggtgaatacgttcccgggccttgtacacaccgcccgtcacaccatgggagtgggttgcaaaagaagtaggtagcttaaccttcgggagggcgcttaccactttgtgattcatgactggggtgaagtc

SEQ ID NO: 123 - DNA, 654 bp, Strenotrophomonas maltophilia
gcttgcaccgcagtagcgcagctacgctttgagcattccgcctggggagtacggtcgcaagattaaaactcaaaggaattgacgggggcccgcacaagcggtggagcatgtggtttaattcgaagcaacgcgcagaaccttaccatcctttgacatggcgtgttacccagagagatctggggtccccttcgggggcgcgcacacaggtgctgcatggctgtcgtcagctcgtgtcgtgagatgttgggttaagtcccgcaacgagcgcaacccacgtccttagttgccatcattcagttgggcactctagggagactgccggtgataagccgcgaggaaggtgtggatgacgtcaagtcctcatggcccttacgggatgggctacacacgtgctacaatggcggtgacagtgggaggcgaaggagcgatctggagcaaatccccaaaagccgtctcagttcggattgcactctgcaactcgagtgcatgaaggcggaatcgctagtaatcgtggatcagcatgccacggtgaatacgttcccgggccttgtacacaccgcccgtcacaccatgggagttggtcttacccgacggcgctgcgccaaccgcaaggaggcaggcgaccacggtagggtcagcgactggggtgaagtc

SEQ ID NO: 124 - DNA, 450 bp, Strenotrophomonas maltophilia
cttgaggcgagccttctggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacagaacttggcagagatgccttggtgccttcgggaactgtgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgaccagggctacacacgtgctacaatggcgcatacaaagagaagcaatctcgcgagagctagcggacctcataaag

SEQ ID NO: 125 - DNA, 656 bp, Strenotrophomonas maltophilia
cttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctggtcttgacatccacagaacttagcagagatgctttggtgccttcgggaactgtgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtc

SEQ ID NO: 126 - DNA, 656 bp, Strenotrophomonas maltophilia; identical to SEQ ID NO: 125

SEQ ID NO: 127 - DNA, 656 bp, Unknown; identical to SEQ ID NO: 125
  source: /note="Description of Unknown: Uncultured seed derived bacterium of the family Enterobacteriaceae"

SEQ ID NO: 128 - DNA, 620 bp, Unknown
  source: /note="Description of Unknown: Uncultured seed derived bacterium of the family Sphingomonadaceae"
cttagagcttcggtggcgcagctaacgcattaagttatccgcctggggagtacggccgcaaggttaaaactcaaatgaattgacgggggcctgcacaagcggtggagcatgtggtttaattcgaagcaacgcgcagaaccttaccagcgtttgacatgtccggacgatttcgggagaccgatctcttcccttcggggactggaacacaggtgctgcatggctgtcgtcagctcgtgtcgtgagatgttgggttaagtcccgcaacgagcgcaaccctcgcctttagttaccatcattcagttggggactctaaaggaaccgccggtgataagccggaggaaggtggggatgacgtcaagtcctcatggcccttacgcgctgggctacacacgtgctacaatggcggtgacagtgggcagcaatcccgcaagggtgagctaatctccaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcagtgcgctaaccgcaaggaggca

SEQ ID NO: 129 - DNA, 656 bp, Pantoea agglomerans; identical to SEQ ID NO: 125

SEQ ID NO: 130 - DNA, 394 bp, Rhodococcus fascians
aatgttgggtttaagtccccgccaacgagcgcaaacccttatccttttgttgcccagcggttaggcccgggaactcaaaggagactgccagtgataaactggaggaaggtggggatgacgtcaagtcatcatggcccttacgaccagggctacacacgtgctacaatggcgcatacaaagagaagcaatctcgcgagagccagcggacctcataaagtgcgtcgtagtccggattggagtctgcaactcgactccatgaagtcggaatcgctagtaatcgtgaatcagaatgtcacggtgaatacgttcccgggccttgtacacaccgcccgtcacaccatgggagtgggttgcaaaagaagtaggtagcttaaccttcggagggcgctaccac

SEQ ID NO: 131 - DNA, 642 bp, Pseudomonas oryzihabitans
atttccttagtaacgtagctaacgcgtgaagttgaccgcctggggagtacggtcgcaagattaaaactcaaaggaattgacggggacccgcacaacgtggatgatgtggattaattcgatgcaacggaaaaaccttacctacccttgacatggtcggaatcctggagagatctgggagtgctcgaaagagaaccgatacacaggtgctgcatggctgtcgtcagctcgtgtcgtgagatgttgggttaagtcccgcaacgagcgcaacccttgtccttagttgctacgcaagagcactctagggagactgccggtgacaaaccggagaaggtggggatgacgtcaagtcctcatggcccttatgggtagggcttcacacgtcatacaatggtcggaacagagggtcgccaacccgcgagggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaagaggacggtcaccacggtaggattcatgactggggtgaagtc

SEQ ID NO: 132 - DNA, 656 bp, Pantoea agglomerans
cttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacagaacttggcagagatgccttggtgccttcgggaactgtgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgaccagggctacacacgtgctacaatggcgcatacaaagagaagcaatctcgcgagagctagcggacctcataaagtgcgtcgtagtccggattggagtctgcaactcgactccatgaagtcggaatcgctagtaatcgtgaatcagaatgtcacggtgaatacgttcccgggccttgtacacaccgcccgtcacaccatgggagtgggttgcaaaagaagtaggtagcttaaccttcgggagggcgcttaccactttgtgattcatgactggggtgaagtc

SEQ ID NO: 133 - DNA, 654 bp, Escherichia coli; identical to SEQ ID NO: 123

SEQ ID NO: 134 - DNA, 657 bp, Methylobacterium radiotolerans
cacggtttccgcgccgcagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgttctcgatcgccgtagagatacggtttcccctttggggcgggttcacaggtggtgcatggttgtcgtcagctcgtgtcgtgagatgttgggttaagtcccgcaacgagcgcaaccctcgttccatgttgccagcacgtcgtggtggggactcatgggagactgccggggtcaactcggaggaaggtgaggacgacgtcaaatcatcatgccccttatgtcttgggcttcacgcatgctacaatggccggtacaatgggttgcgatactgtgaggtggagctaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagtcggtaacacccgaagccggtggcctaacccttgtggggggagccgtcgaaggtgggaccagcgattgggactaagtc

SEQ ID NO: 135 - DNA, 646 bp, Escherichia coli
attgacttggtaacgtagctaacgcgtgaagttgaccgcctggggagtacggtcgcaagattaaaactcaaaggaattgacggggacccgcacaaggggggatgatgtggattaattcgatgcaacggaaaaaccttacctacccttgacatgtatggaatcctgctgagaggtgggagtgcccgaaagcaagccataacacaggtgctgcatggctgtcgtcagctcgtgtcgtgagatgttgggttaagtcccgcaacgagcgcaacccttgtccctagttgctacgcagagcactctagggagactgccggtgacaaaccggaggaaggtggggatgacgtcaagtcctcatggcccttatgggtagggcttcacacgtcatacaatggtcggaacagagggtcgccaacccgcgaggggccgccaatcccagaaaaccgatcgtagtccggatcgcactctgcaactcgagtgcgtgaagctggaatcgctagtaatcgcggatcagcatgccgcggtgaatacgttcccgggtcttgtacacaccgcccgtcacaccatgggagtgggttttaccagaagtggctagtctaaccgcaagagggacggtcaccacggtaggattcatgactggggtgaagtc

SEQ ID NO: 136 - DNA, 651 bp, Enterobacter sp.
tctgccccttagttctgcagtaacgcattaagcactccgcctgggagtacgaccgcaaggtgaaactcaaaggaattgacggggacccgcacaagcgggaagcatgtggtttaattcgaagcaacgggagaaccttaccaaatcttgacatcctttgaccgctctagagatagagtcttccccttcggggtacaaagtgacaggtggtgcatggttgtcgtcagctcgtgtcgtgagatgttgggttaagtcccgcaacgagcgccacccttaagcttagttgccatcattaagttgggcactctaagttgactgccggtgacaaaccgtaggaagggggggatgacgtcaaatcatcatgccccttatgatttgggctacacacgtgctacaatggacaatacacagggcagctaaaccgcgagtcaagcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccatttatggagctagccgtcgaaggtgggacaaatgattgggtgaagtc

SEQ ID NO: 137 - DNA, 509 bp, Enterobacter sp.
gttaattgatccccttggggagtccggccccaaggttaaaattcaaaggaatggacgggggccggcccaagcggtggaccatggggtttaattggaggcaacgggaggacccttaccggctttggccatcaacggacgtttccgggaaggatttgtgcctttggggacattgggaccagaggtgcaaggctgttgtcatcttgtgttgtgggaagatggggtaaattccctcacgagggccacccctttccttatttaccaacatgttatggtgggcactctaaggagactgccggtgacaaaccggaggaaggtggggatgacgtcaagtcatcatggcccttacggcctgggctacacacgtgctacaatggtcggtacaaagggaagccaatccggagatcgagctaatttcataaaagcgatcgtagtccggatcgcagtctgcaactcgaatccgtgaagtcggaatcgttagtaacgcgaatcagaatgttcggtgaatacgt

SEQ ID NO: 138 - DNA, 656 bp, Enterobacter sp.
cttgaggcgtggcttccggagctaacgcgttaaatcgaccccctggggagtacggccgcaaggttaaaactcaaatgaattgacgggggcccgcacaagcggtggagcatgtggtttaattcgatgcaacgcgaagaaccttacctggtcttgacatccacagaacttaccagagatgctttggtgccttcgggaactgtgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtc

SEQ ID NO: 139 - DNA, 533 bp, Sphingomonas sp.
gcatgtggttaattcgagcacggagaacttaccatcctttgacatggcgtgttatgggggagagattcccagtcctcttcggagcgcgcacacaggtgctgcatggctgtcgtcagctcgtgtcgtgagatgttgggtaagtcccgcaacgagcgcaacccacgtccttagttgccatcattcagtgggcactctagggagactgccggtgataagccgcgagaaggtgtggatgacgtcaagtcctcatggcccttacgggatgggctacacacgtgctacaatggcggtgacagtgggacgcgaaggggcgacctggagcaaatccccaaaagccgtctcagttcggattgcactctgcaactcgggtgcatgaaggcggaatcgctagtaatcgtggatcagcatgccacggtgaatacgttcccgggccttgtacacaccgcccgtcacaccatgggagttggtcttacccgacgcgctgcgcaaccgcaagagcaggcgaccacggtaggtcagcgactgggtgagtc

SEQ ID NO: 140 - DNA, 644 bp, Hafnia alvei
atttccttagtaacgtagctaacgcgtgaagttgaccgcctggggagtacggtcgcaagattaaaactcaaaggaattgacggggacccgcacaagcgtggatgatgtggattaattcgatgcaacggaaaaaccttacctacccttgacatggtcggaatcctggagagatctgggagtgctcgaaagagaaccgatacacaggtgctgcatggctgtcgtcagctcgtgtcgtgagatgttgggttaagtcccgcaacgagcgcaacccttgtccttagttgctacgcaagagcactctagggggactgccggtgacaaaccggaggaaggtggggatgacgtcaagtcctcatggcccttatgggtagggcttcacacgtcatacaatggtcggaacagagggtcgccaacccgcgagggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaagaggacggtcaccacggtaggattcatgactggcgtgaagtc

SEQ ID NO: 141 - DNA, 656 bp, Escherichia coli
cttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacagaacttgccagagatggattggtgccttcgggaactgtgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgaccagggctacacacgtgctacaatggcgcatacaaagagaagcaatctcgcgagagcaagcggacctcataaagtgcgtcgtagtccggattggagtctgcaactcgactccatgaagtcggaatcgctagtaatcgtgaatcagaatgtcacggtgaatacgttcccgggccttgtacacaccgcccgtcacaccatgggagtgggttgcaaaagaagtaggtagcttaaccttcgggagggcgcttaccactttgtgattcatgactggggtgaagtc

SEQ ID NO: 142 - DNA, 650 bp, Burkholderia gladioli
tcagcccattagtgctgcagtaacgcattaagcactccgcctggggagtacgaccgcaagtgaaactcaaaggaattgacggggaccgcacaagcgtggagcatgtggtttaattcgaagcaacggtggaaccttaccaaatcttgacatcctctgactcctctagagttagagttttccccttcggtgcccttagtgacaggtggtgcatggttgtcgtcagctcgtgtcgtgagatgttggtttaagtcccgcaacgagcgcttcccttaagcttagttgccatcattaagttgggcactctaagttgactgccggtgacaaaccgaaggaaggtggggatgacgtcaaatcatcatgccctttatgatttgggctacacacgtgctacaatggacaatacacagggcagcgaaaccgcgagttcaagcaaatcccataaagttgttctcagttcggattgtagtctgcaactcgactatatgaagctggaatcgctagtaatcgtagatcagcatgctacggtgaatacgttcccgggtcttgtacacaccgcccgtcacaccacgagagtttgtaacacccgaagccggtggagtaaccatttggagctagccgtcgaaggtgggacaaatgattggagtgaagtc

SEQ ID NO: 143 - DNA, 656 bp, Escherichia coli
tcggccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctctgacccctctagagatagagttttccccttcgggggacagagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacaatacgaagggtagcgaaaccgcgagttcaagcaaatcccataaagttgttctcagttcggattgtagtctgcaactcgactatatgaagctggaatcgctagtaatcgtagatcagcatgctacggtgaatacgttcccgggtcttgtacacaccgcccgtcacaccacgagagtttgtaacacccgaagccggtggagtaaccatttggagctagccgtcgaaggtgggacaaatgattggggtgaagtc

SEQ ID NO: 144 - DNA, 655 bp, Methylobacterium radiotolerans
gcttgcacctcagtagcgcagctaacgctttgagcattccgcctggggagtacggtcgcaagattaaaactcaaaggaattgacgggggcccgcacaagcggtggagcatgtggtttaattcgaagcaacgcgcagaaccttaccatcctttgacatggcgtgttatggggagagattcccagtcctcttcggaggcgcgcacacaggtgctgcatggctgtcgtcagctcgtgtcgtgagatgttgggttaagtcccgcaacgagcgcaacccacgtccttagttgccatcattcagttgggcactctagggagactgccggtgataagccgcgaggaaggtgtggatgacgtcaagtcctcatggcccttacgggatgggctacacacgtgctacaatggcggtgacagtgggacgcgaaggggcgacctggagcaaatccccaaaagccgtctcagttcggattgcactctgcaactcgggtgcatgaaggcggaatcgctagtaatcgtggatcagcatgccacggtgaatacgttcccgggccttgtacacaccgcccgtcacaccatgggagttggtcttacccgacggcgctgcgccaaccgcaaggaggcaggcgaccacggtagggtcagcgactggggtgaagtc

SEQ ID NO: 145 - DNA, 611 bp, Micrococcus luteus
cttgagcttttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggaacattgagacaggtgctgcatggctgtcgtcagctcgtgtcgtgagatgttgggttaagtcccgtaacgagcgcaacccttgtccttagttaccagcacgtgatggtgggcactctaaggagactgccggtgacaaaccggaggaaggtggggatgacgtcaagtcatcatggcccttacggcctgggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgctaatcagaatgtcgcggtgaatacgttcccgggccttgtacacaccgcccgttacaccatggaagtgagttgcaccagaattagctagtctaacct

SEQ ID NO: 146 - DNA, 652 bp, Burkholderia phytofirmans
ttcattgacttggtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtatggaatcctgctgagaggtgggagtgcccgaaagggagccataacacaggtgctgcatggctgtcgtcagctcgtgtcgtgagatgttgggttaagtcccgcaacgagcgcaacccttgtccctagttgctacgcaagagcactctagggagactgccggtgacaaaccggaggaaggtggggatgacgtcaagtcctcatggcccttatgggtagggcttcacacgtcatacaatggtcggaacagagggtcgccaacccgcgagggggagccaatcccagaaaaccgatcgtagtccggatcgcactctgcaactcgagtgcgtgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtc

SEQ ID NO: 147 - DNA, 657 bp, Staphylococcus warneri
cttgagcttttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggaacattgagacaggtgctgcatggctgtcgtcagctcgtgtcgtgagatgttgggttaagtcccgtaacgagcgcaacccttgtccttagttaccagcacgtgatggtgggcactctaaggagactgccggtgacaaaccggaggaaggtggggatgacgtcaagtcatcatggcccttacggcctgggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtc

SEQ ID NO: 148 - DNA, 656 bp, Pseudomonas fluorescens
cttagagcttcggtggcgcagctaacgcattaagttatccgcctggggagtacggccgcaaggttaaaactcaaatgaattgacgggggcctgcacaagcggtggagcatgtggtttaattcgaagcaacgcgcagaaccttaccagcgtttgacatgtccggacgatttcgggagaccgatctcttcccttcggggactggaacacaggtgctgcatggctgtcgtcagctcgtgtcgtgagatgttgggttaagtcccgcaacgagcgcaaccctcgtccttagttgccatcatttagttgggcactctaaggaaaccgccggtgataagccggaggaaggtggggatgacgtcaagtcctcatggcccttacgcgctgggctacacacgtgctacaatggcggtgacagtgggcagcaatctcgcaagggtgagctaatctccaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcagtgcgctaaccgcaaggaggcagctgaccacggtgggttcagcgactggggtgaagtc

SEQ ID NO: 149 - DNA, 624 bp, Enterobacter cloacae
cttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgatacggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcta

SEQ ID NO: 150 - DNA, 657 bp, Methylobacterium brachiatum
cttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgagtcatgtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtc

SEQ ID NO: 151 - DNA, 334 bp, Burkholderia gladioli
tcgaccgcctggggagtacggccgcaaggttaaaactcaaatgaattgacgggggcccgcacaagcggtggagcatgtggtttaattcgatgcaacgcgaagaaccttacctggccttgacatccagagaacttatcagagatgctttggtgccttcgggaactctgagacaggtgctgcaggctgtcgtcagctcgtgttgtgaaatgttgggttaagtcccgcaacgagcgcaacccttatcctttgttgccagcggctcggccgggaactcaaaggagactgccggtgataaaccggaggaaggtggggatgacgacaagtcatcatggcc

SEQ ID NO: 152 - DNA, 657 bp, Escherichia coli
cttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctggtcttgacatccacagaactttccagagatgcattggtgccttcgggaactgtgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtaatccggattggagtctgcaactcgactccatgaagtcggaatcgctagtaatcgtagatcaaaatgctacggtgaatacgttcccgggccttgtacacaccgcccgtcacaccatgggagtgggttgcaaaagaagtaggtagcttaaccttcgggagggcgcttaccactttgtgattcatgactgggggtgaagtc

SEQ ID NO: 153 - DNA, 657 bp, Staphylococcus sp.; identical to SEQ ID NO: 147

SEQ ID NO: 154 - DNA, 657 bp, Staphylococcus epidermitis
cttgagcttttagtggcgcagctaacgcattaagttgaccgcctggggagtacggccgcaaggttaaaactcaaatgaattgacgggggcccgcacaagcggtggagcatgtggtttaattcgaagcaacgcgaaaaaccttaccaggccttgacatccaatgaactttccagagatggattggtgccttcgggaacattgagacaggtgctgcatggctgtcgtcagctcgtgtcgtgagatgttgggttaagtcccgtaacgagcgcaacccttgtccttagttaccagcacgtgatggtgggcactctaaggagactgccggtgacaaaccggaggaaggtggggatgacgtcaagtcatcatggcccttacggcctgggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtc

SEQ ID NO: 155 - DNA, 657 bp, Methylobacterium brachiatum
cttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccactgaattcggcagagatgccttggtgccttcgggaaccgtgagacaggtgctgcatggctgtcgtcagctcgtgttgtgaaatgttgggttaagtcccgcaacgagcgcaacccttatcctttgttgccagcgagtcatggcgggaactcaaaggagactgccggtgataaaccggaggaaggtggggatgacgtcaagtcatcatggcccttacgagtagggctacacacgtgctacaatggcgcatacaaagagaagcgacctcgcgagagcgagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtc

SEQ ID NO: 156 - DNA, 656 bp, Pseudomonas putida
cttgaggagtggcttccggagctaacgcgttaagtgaccgcctggggagtacggccgcaaggttaaaactcaaatgaattgacgggggcccgcacaagcggtggagcatgtggtttaattcgatgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgagtcatgtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaataattaggtagcttaaccttcgggagggcgcttaccactttttgatttcatgactggggtgaattc

SEQ ID NO: 157 - DNA, 613 bp, Burkholderia phytofirmans
gaccgcctggggagtacggccgcaaggttaaaactcaaatgaattgacgggggcccgcacaagcggtggagcatgtggtttaattcgaagcaacgcgaagaaccttacctagtcttgacatccaatgaactttccagagatggattggtgccttcgggaacattgagacaggtgctgcatggctgtcgtcagctcgtgtcgtgagatgttgggttaagtcccggaacgagcgcaacccttgtccttagttaccggcacgtgatggtgggaactctaaggagactgccggtgacaaaccggaggaaggtggggatgacgtcaagtcatcatggcccttacgacctgggctacacacgtgctacaatggtcgatacaaagggttgccaccccgcgaggtggagctaatcccataaagcggatcgtagtccggatcgcagtctgcaactcgactgcgtgaagtcggaatcgctagtaatcgcgaatcagaatgccgcggtgaatacgttcccgggccttgtacacaccgcccgtcacaccatgggagtgggttgcaccagaagtagctagctctaaccttcgggaggacgcttaccactttgtgattcatgactgg

SEQ ID NO: 158 - DNA, 626 bp, Pseudomonas putida
cttgagcttttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggaacattgagacaggtgctgcatggctgtcgtcagctcgtgtcgtgagatgttgggttaagtcccgtaacgagcgcaacccttgtccttagttaccagcacgtgatggtgggcactctaaggagactgccggtgacaaaccggaggaaggtggggatgacgtcaagtcatcatggcccttacggcctgggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggtac

SEQ ID NO: 159 - DNA, 657 bp, Sphingomonas sp.; identical to SEQ ID NO: 150

SEQ ID NO: 160 - DNA, 657 bp, Pantoea agglomerans
cttgagatcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggataggtgccttcgggagctcagacacaggtgctgcatggctgtcgtcagctcgtgtcgtgagatgttgggttaagtcccgtaacgagcgcaacccttgtccttagttaccagcacgtgatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccctcgggaggacggttaccacggagtgattcatgactggggtgaagtc

SEQ ID NO: 161 - DNA, 657 bp, Pantoea agglomerans; identical to SEQ ID NO: 147

SEQ ID NO: 162 - DNA, 657 bp, Pantoea dispersa
cttgagcttttagtggcgcagctaacgcattaagttgaccgcctggggagtacggccgcaaggttaaaactcaaatgaattgccgggggcccgcacaagcggtggagcatgtggtttaattcgaagcaacgcgaagaaccttaccaggccttgacatccaatgaactttccagagatggattggtgccttcgggaacattgagacaggtgctgcatggctgtcgtcagctcgtgtcgtgagatgttgggttaagtcccgtaacgagcgcaacccttgtccttagttaccagcacgtgatggtgggcactctaaggagactgccggtgacaaaccggaggaaggtggggatgacgtcaagtcatcatggcccttacggcctgggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgcgaatcagaatgtcgcggtgaatacgttcccgggccttgttcacaccgcccgtcacaccatgggagtgggttgcaccagaagtagctagtctaaccttcgggaggacggttaccacggtgtgattcatgactggggtgaagtc

SEQ ID NO: 163 - DNA, 481 bp, Enterobacter cloacae
cgcgaaaaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgagtcatgtcgggaactcaaaggagactgccggtgataaaccggaagaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtctaccatgggagtgggttgcaaagaataggtagcttttccttc

SEQ ID NO: 164 - DNA, 654 bp, Pseudomonas putida
cttgaggagtggcttccggagctaacgcgttaagtcgaccgcctggggagtacggccgcaagtttaaaactcaaatgaattgacgggggcccgcacaagcgtggagcatgtggtttaattcgatgcaacggaagaaccttacctactcttgacatccacggaattcggcagagatgccttagtgccttcgggaaccgtgagacaggtgctgcatgctgtcgtcagctcgtgttgtgaaatgttgggttaagtcccgcaacgagcgcaacccttatcctttgttgccagcgagtcatgtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtc

SEQ ID NO: 165 - DNA, 617 bp, Pseudomonas putida
cttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactttgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaacctcgggagg

SEQ ID NO: 166 - DNA, 464 bp, Pantoea agglomerans
cttgaggcgtgcttctggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggggggatgacgtcaagtcatcatggcccttacgagtagggctacacacgtgctacaatggcgcatacaaagagaagcgacctcgcgagagcaagcggacctcataaagtgcgtcgtagtccgga

SEQ ID NO: 167 - DNA, 655 bp, Pantoea agglomerans
gcttgcaccgcagtagcgcagctaacgctttgagcattccgcctggggagtacggtcgcaagattaaaactcaaaggaattgacgggggcccgcacaagcggtggagcatgtggtttaattcgaagcaacgcgcagaaccttaccatcctttgacatggcgtgttacccagagagatctggggtccccttcgggggcgcgcacacaggtgctgcatggctgtcgtcagctcgtgtcgtgagatgttgggttaagtcccgcaacgagcgcaacccacgtccttagttgccatcattcagttgggcactctagggagactgccggtgataagccgcgaggaaggtgtggatgacgtcaagtcctcatggcccttacgggatgggctacacacgtgctacaatggcggtgacagtgggaggcgaaggagcgatctggagcaaatccccaaaagccgtctcagttcggattgcactctgcaactcgagtgcatgaaggcggaatcgctagtaatcgtggatcagcatgccacggtgaatacgttcccgggccttgtacacaccgcccgtcacaccatgggagttggtcttacccgacggcgctgcgccaaccgcaaggaggcaggcgaccacggtagggtcagcgactggggtgaagtc

SEQ ID NO: 168 - DNA, 618 bp, Pseudomonas putida
cttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggctcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagg

SEQ ID NO: 169 - DNA, 657 bp, Pseudomonas tolaasii; identical to SEQ ID NO: 147

SEQ ID NO: 170 - DNA, 656 bp, Pantoea agglomerans
cccacgagttccgtgccgcagcaaacgcattaagtgccccgcctggggagtacggccgcaaggctaaaactcaaagaaattgacgggggcccgcacaagcggcggagcatgcggattaattcgatgcaacgcgaagaaccttaccaaggcttgacatacaccggaaacttccagagatggttgccccgcaaggtcggtgtacaggtggtgcatggttgtcgtcagctcgtgtcgtgagatgttgggttaagtcccgcaacgagcgcaaccctcgtcctatgttgccagcgggttatgccggggactcataggagactgccggggtcaactcggaggaaggtggggatgacgtcaaatcatcatgccccttatgtcttgggcttcacgcatgctacaatggccggtacaaagggctgcgataccgcgaggtggagcgaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagtcggtaacacccgaagccggtggcccaacccttgtggggggagccgtcgaaggtgggactggcgattgggactaagtc

SEQ ID NO: 171 - DNA, 657 bp, Pseudomonas oryzihabitans
tccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgggccggatcgccgcagaaatgtggtttcccctttggggccggttcacaggtggtgcatggttgtcgtcagctcgtgtcgtgagatgttgggttaagtcccgcaacgagcgcaaccctcgttctatgttgccagcgcgtgatggcggggactcataggagactgccggggtcaactcggaggaaggtggggacgacgtcaaatcatcatgccccttatgtcttgggcttcacgcatgctacaatggccggtacaaagggttgcgatactgtgaggtggagctaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagttgtaacacccgaagccggtgcctaaccccttgtggagggagctgtcgaaggtgggactggcgattggactaagtc

SEQ ID NO: 172 - DNA, 653 bp, Pseudomonas putida
ccgagttccgtgccgcagcaaacgcattaagtgccccgcctggggagtacggccgcaaggctaaaactcaaagaaattgacgggggcccgcacaagcggcggagcatgcggattaattcgatgcaacgcgaagaaccttaccaaggcttgacatacaccggaaacttccagagatggttgccccgcaaggtcggtgtacaggtggtgcatggttgtcgtcagctcgtgtcgtgagatgttgggttaagtcccgcaacgagcgcaaccctcgtcctatgttgccagcgggttatgccggggactcataggagactgccggggtcaactcggaggaaggtggggatgacgtcaaatcatcatgccccttatgtcttgggcttcacgcatgctacaatggccggtacaaagggctgcgataccgcgaggtggagcgaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagtcggtaacacccgaagccggtggcccaacccttgtggggggagccgtcgaaggtgggactggcgattgggactaagtc

SEQ ID NO: 173 - DNA, 456 bp, Pseudomonas putida
gagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtc

SEQ ID NO: 174 - DNA, 656 bp, Pantoea agglomerans
cttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacagaacttagcagagatgctttggtgccttcgggaactctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtc

SEQ ID NO: 175 - DNA, 657 bp, Pantoea agglomerans; identical to SEQ ID NO: 171

SEQ ID NO: 176 - DNA, 603 bp, Enterobacter asburiae
gccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcgtggctgtcgtcagctcgtgttgtgaaatgttgggttaagtcccgcaacgagcgcaccccttatcctttgttgccagcggtccggccgggaactctaaggagactgccagtgataaactgaaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccttgaagtcggaatcgctagtaatcgtagatcacaatgctacggtgaatacgttcccgggccttgtacacaccgcccgtcacaccatgggagtgggttgcaaaagaagtaggtggcttaaccttcgggagggcgcttaccactttgtgattcatgactgtgggtgaagtc

SEQ ID NO: 177 - DNA, 656 bp, Enterobacter asburiae
cttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtc

SEQ ID NO: 178 - DNA, 654 bp, Methylobacterium radiotolerans
ccttgagcgtggttccggagctaacgcgttaagtcgaccgcctggggagtacggccgcaaggttaaaactcaaatgaattgacgggggcccgcacaagcgtggagcatgtggtttaattcgatgcaacgcgaagaaccttacctggtcttgacatccacggaatttggcagagatgccttagtgccttcgggaaccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcatatacaaagagaagcgacctcgcgagaccaagcggacctcataaagtatgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtc

SEQ ID NO: 179 - DNA, 656 bp, Pantoea dispersa
cttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggctcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtc

SEQ ID NO: 180 - DNA, 360 bp, Pseudomonas putida
cggccgggaactcaaaggagactgccagtgataaactggaggaaggtggggatgacgtcaagtcatcatggcccttacgagtagggctacacacgtgctacaatggcgcatacaaagagaagcgaactcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtc

SEQ ID NO: 181 - DNA, 657 bp, Cellulomonas denverensis
tttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggccttgacatgtcgagaactttccagagatggattggtgccttcgggaactcgaacacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacggccagggctacacacgtactacaatggtagggacagagggctgcaagccggcgacggtaagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgcttgccacggtgtggccgatgactggggtgaagtc

SEQ ID NO: 182 - DNA, 657 bp, Arthrobacter ramosus
ttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggccttgacatgtcgagaactttccagagatggattggtgccttcgggaactcgaacacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacggccagggctacacacgtactacaatggtagggacagagggctgcaagccggcgacggtaagccgatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgcttgccacggtgtggccgatgactgggggtgaagtc

SEQ ID NO: 183 - DNA, 656 bp, Cellulomonas denverensis
cttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctggtcttgacatccacagaactttccagagatggattggtgccttcgggaactgtgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgaccagggctacacacgtgctacaatggcatatacaaagagaagcgacctcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtc

SEQ ID NO: 184 - DNA, 656 bp, Pantoea ananatis
cttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttacccctttgtgattcatgactggggtgaagtc

SEQ ID NO: 185 - DNA, 663 bp, Pantoea ananatis
tcgatacccttggtgccgaagttaacacagtaagcactccgcctggggagtacggtcgcaagactgaaactcaaaggaattgacggggacccgcacaagcagtggagtatgtggtttaattcgaagcaacgcgaagaaccttaccaggtcttgacatccaactaacgaagcagagatgcatcaggtgcccttcggggaaagttgagacaggtggtgcatggttgtcgtcagctcgtgtcgtgagatgttgggttaagtcccgcaacgagcgcaacccttgactttagttgccagcaggtggagctgggcactctagagtgactgccggtgacaaaccggaggaaggtggggatgacgtcaaatcatcatgccccttatgacctgggctacacacgtactacaatggccggtacaacgggaagcgaagccgcgaggcggagccaatcccagcaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaacccgcaagggagccagccgccgaaggtggggtagatgattggggtgaagtc

SEQ ID NO: 186 - DNA, 632 bp, Arthrobacter sp.
tcgatacccttggtgccgaagttaacacagtaagcactccgcctggggagtacggtcgcaagactgaaactcaaaggaattgacggggacccgcacaagcagtggagtatgtggtttaattcgaagcaacgcgaagaaccttaccaggtcttgacatccaactaacgaagcagagatgcatcaggtgcccttcggggaaagttgagacaggtggtgcatggttgtcgtcagctcgtgtcgtgagatgttgggttaagtcccgcaacgagcgcaacccttgactttagttgccagcaggtgaagctgggcactctagagtgactgccggtgacaaaccggaggaaggtggggatgacgtcaaatcatcatgccccttatgacctgggctacacacgtactacaatggccggtacaacgggaagcgaagccgcgaggcggagccaatcccagcaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaacccgcaagggagccagccgc

SEQ ID NO: 187 - DNA, 659 bp, Enterobacter asburiae
tcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaggtcttgacatccccctgaccggtctagagataggcctttccttcgggacaggggagacaggtggtgcatggttgtcgtcagctcgtgtcgtgagatgttgggttaagtcccgcaacgagcgcaacccttgactttagttgccagcaggtaaggctgggcactctagagtgactgccggtgacaaaccggaggaaggtggggatgacgtcaaatcatcatgccccttatgacctgggctacacacgtactacaatggccggtacaacgggaagcgaaggagcgatctggagcgaatctttagaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaacccgcaagggagccagccgccgaaggtggggtagacgattggggtgaagtc

SEQ ID NO: 188 - DNA, 387 bp, Enterobacter cloaceae
gcgatacccttggtgccgaagttaacacattaagcattccgcctggggagtacgggcgcaagactgaaactcaaaggaattgacggggacccgcacaagcagtggagtatgtggtttaattcgaagcaacgcgaagaaccttaccaggtcttgacatccccctgaccggtctagagataggcctttccttcgggacaggggagacaggtggtgcatggttgtcgtcagctcgtgtcgtgagatgttgggttaagtcccgcaacgagcgcaacccttgactttagttgccagcaggtaaggctgggcactctagagtgactgccggtgacaaaccggaggaaggtggggatgacgtcaaatcatcatgccccttatgacctgggctac

SEQ ID NO: 189 - DNA, 656 bp, Enterobacter hormaechei
tccacgagttccgtgccgcagcaaacgcattaagtgccccgcctggggagtacggccgcaaggctaaaactcaaagaaattgacgggggcccgcacaagcggcggagcatgcggattaattcgatgcaacgcgaagaaccttaccaaggcttgacatacaccggaaacttccagagatggttgccccgcaaggtcggtgtacaggtggtgcatggttgtcgtcagctcgtgtcgtgagatgttgggttaagtcccgcaacgagcgcaaccctcgtcctatgttgccagcgggttatgccggggactcataggagactgccggggtcaactcggaggaaggtggggatgacgtcaaatcatcatgccccttatgtcttgggcttcacgcatgctacaatggccggtacaaagggctgcgataccgcgaggtggagcgaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagtcggtaacacccgaagccggtggcccaacccttgtggggggagccgtcgaaggtgggactggcgattgggactaagtc

SEQ ID NO: 190 - DNA, 657 bp, Pantoea dispersa
ccacggtttccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgctgcagaaatgtagaactctttggacactcgtatacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcctaacccttgtggagggagccgtcgaaggtgggatcggtaattaggactaagtc

SEQ ID NO: 191 - DNA, 663 bp, Enterobacter cloacae
tcgatacccttggtgccgaagttaacacagtaagcactccgcctggggagtacggtcgcaagactgaaactcaaaggaattgacggggacccgcacaagcagtggagtatgtggtttaattcgaagcaacgcgaagaaccttaccaggtcttgacatccaactaacgaagcagagatgcatcaggtgcccttcggggaaagttgagacaggtggtgcatggttgtcgtcagctcgtgtcgtgagatgttgggttaagtcccgcaacgagcgcaacccttgactttagttgccagcaggtgaagctgggcactctagagtgactgccggtgacaaaccggaggaaggtggggatgacgtcaaatcatcatgccccttatgacctgggctacacacgtactacaatggccggtacaacgggaagcgaagccgcgaggcggagccaatcccagcaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaacccgcaagggagccagccgccgaaggtggggtagatgattggggtgaagtc

SEQ ID NO: 192 - DNA, 663 bp, Stenotrophomonas maltophilia; identical to SEQ ID NO: 191

SEQ ID NO: 193 - DNA, 656 bp, Stenotrophomonas maltophilia
cttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaatttggcagagatgccttagtgccttcgggaaccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcatatacaaagagaagcgacctcgcgagagcaagcggacctcataaagtatgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaaagt

SEQ ID NO: 194 - DNA, 658 bp, Klebsiella pneumoniae
tatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagctcttgacattcggggtatgggcattggagacgatgtccttcagttaggctggccccagaacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagacagcgatgtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttttacccgaaggtagtgcgctaaccgcaaggaggcagctaaccacggtagggtcagcgactggggtgaagtc

SEQ ID NO: 195 - DNA, 656 bp, Citrobacter freundii; identical to SEQ ID NO: 121

SEQ ID NO: 196 - DNA, 656 bp, Paenibacillus caespitis; identical to SEQ ID NO: 121

SEQ ID NO: 197 - DNA, 657 bp, Paenibacillus graminis; identical to SEQ ID NO: 150

SEQ ID NO: 198 - DNA, 656 bp, Paenibacillus sp.
cttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgacacggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtc

SEQ ID NO: 199 - DNA, 657 bp, Paenibacillus sp.
cttgagcttttagtggcgcagctaacgcattaagttgaccgcctgatgagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggagcattgagacaggtgctgcatggctgtcgtcagctcgtgtcgtgagatgttgggttaagtcccgtaacgagcgcaacccttgtccttagttaccagcacgtgatggtgggcactctaaggagactgccggtgacaaaccggaggaaggtggggatgacgtcaagtcatcatggcccttacggcctgggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtc

SEQ ID NO: 200 - DNA, 496 bp, Cellulomonas denverensis
gcaacgcgaagaaaccttacctggccttgacatgcaatgaactttccagagatggattggtgccttcgggaactcagacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaatgtcgcggtgaatacgttcccgggccttgtacacaccgcccgtcacaccatgggagtgggttgctccagaagtagctagtctaaccttcgggagga

SEQ ID NO: 201 - DNA, 656 bp, Microbacterium sp.; identical to SEQ ID NO: 121

SEQ ID NO: 202 - DNA, 657 bp, Paenibacillus caespitis
cttgagcttttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggaacattgagacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccataaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtc

SEQ ID NO: 203 - DNA, 656 bp, Paenibacillus caespitis
cttgagcttttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggaacattgagacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccataaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccataatgagttagtctaccttcgggaggacggttaccacagcgtgattcatgactggtgtgaagtc

SEQ ID NO: 204 - DNA, 657 bp, Enterobacter asburiae
cttgagcttttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggagcattgagacaggtgctgcatggctgtcgtcagctcgtgtcgtgagatgttgggttaagtcccgtaacgagcgcaacccttgtccttagttaccagcacgtgatggtgggcactctaaggagactgccggtgacaaaccggaggaaggtggggatgacgtcaagtcatcatggcccttacggcctgggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtc

SEQ ID NO: 205 - DNA, 477 bp, Rhizobium sp.
cttgagcttttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttctagagatagattggtgccttcgggaacattgagacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggaacaaagggttgccaagccgcgaggtggagttaatcccataaaaccgatcgtactccggatcgcagctgc

SEQ ID NO: 206 - DNA, 657 bp, Pantoea agglomerans
cttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagcgaattcggcagagatgccttagtgccttcgggaacgctgagacaggtgctgcatggctgtcgtcagctcgtgttgtgaaatgttgggttaagtcccgcaacgagcgcaacccttatcctttgttgccagcacgtaatggtgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtc

SEQ ID NO: 207 - DNA, 656 bp, Pantoea agglomerans
tttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggccttgacatgtcgagaactttccagagatggattggtgccttcgggaactcgaacacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacggccagggctacacacgtactacaatggtagggacagagggctgcaagccggcgacggtaagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccaaaagcaggtagcttaccttcgggagggcgcttgccacggtgtggccgatgattggggtgaagtc

SEQ ID NO: 208 - DNA, 656 bp, Pantoea agglomerans; identical to SEQ ID NO: 121

SEQ ID NO: 209 - DNA, 652 bp, Pantoea agglomerans; identical to SEQ ID NO: 146

SEQ ID NO: 210 - DNA, 652 bp, Pseudomonas putida; identical to SEQ ID NO: 146

SEQ ID NO: 211 - DNA, 660 bp, Pseudomonas sp.
tccacgttgtccgtgccgcagctaacgcattaagtgccccgcctggggagtacggccgcaaggctaaaactcaaaggaattgacgggggcccgcacaagcggcggagcatgtggcttaattcgacgcaacgcgaagaaccttaccaaggcttgacatacaccggaaacgtctggagacaggcgcccccttgtggtcggtgtacaggtggtgcatggctgtcgtcagctcgtgtcgtgagatgttgggttaagtcccgcaacgagcgcaacccttgtcccgtgttgccagcaggcccttgtggtgctggggactcacgggagaccgccggggtcaactcggaggaaggaggggacgacgtcaagtcatcatgccccttatgtcttgggctgcacacgtgctacaatggccggtacaatgagctgcgataccgcgaggtggagcgaatctcaaaaagccggtctcagttcggattggggtctgcaactcgaccccatgaagtcggagtcgctagtaatcgcagatcagcattgctgcggtgaatacgttcccgggccttgtacacaccgcccgtcacgtcacgaaagtcggtaacacccgaagccggtggcccaacccccttgtgggagggagctgtcgaaggtgggactggcgattgggac

SEQ ID NO: 212 - DNA, 654 bp, Pantoea agglomerans
gttgcacctcagtagcgcagctaacgctttgagcattccgcctggggagtacggtcgcaagattaaaactcaaaggaattgacgggggcccgcacaagcggtggagcatgtggtttaattcgaagcaacgcgcagaaccttaccatcctttgacatggcgtgttatggggagagattcccagtcctcttcggaggcgcgcacacaggtgctgcatggctgtcgtcagctcgtgtcgtgagatgttgggttaagtcccgcaacgagcgcaacccacgtccttagttgccatcattcagttgggcactctagggagactgccggtgataagccgcgaggaaggtgtggatgacgtcaagtcctcatggcccttacgggatgggctacacacgtgctacaatggcggtgacagtgggacgcgaaggggcgacctggagcaaatccccaaaagccgtctcagttcggattgcactctgcaactcgggtgcatgaaggcggaatcgctagtaatcgtggatcagcatgccacggtgaatacgttcccgggccttgtacacaccgcccgtcacaccatgggagttggtcttacccgacggcgctgcgccaaccgcaaggaggcaggcgaccacggtagggtcagcgactggggtgaagtc

SEQ ID NO: 213 - DNA, 660 bp, Pseudomonas synxantha
tcgatacccttggtgccgaagttaacacattaagcactccgcctggggagtacggtcgcaagactgaaactcaaaggaattgacggggacccgcacaagcagtggagtatgtggtttaattcgaagcaacgcgaagaaccttaccaggtcttgacatccaactaacgaggcagagatgcgttaggtgcccttcggggaaagttgagacaggtggtgcatggttgtcgtcagctcgtgtcgtgagatgttgggttaagtcccgcaacgagcgcaacccttatatttagttgccagcacttcgggtgggcactctagatagactgccggtgacaaaccggaggaaggtggggatgacgtcaaatcatcatgccccttatgacctgggctacacacgtactacaatggccggtacaacgggctgcgaaatcgcgagatggagccaatcccaacaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaaccgcaaggagccagccgccgaaggtgggatagatgattggggtgaagtc

SEQ ID NO: 214 - DNA, 626 bp, Pseudomonas fluorescens
cttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgctacc

SEQ ID NO: 215 - DNA, 657 bp, Pseudomonas putida
ctcggagatcagtgtcgaagctaacgcgttaagttcgccgcctggggagtacggtcgcaagactgaaactcaaaggaattgacgggggcccgcacaagcggtggagtatgtggtttaattcgatgcaacgcgaagaaccttacctggccttgacatgtccggaatcctgcagagatgcgggagtgccttcgggaatcggaacacaggtgctgcatggctgtcgtcagctcgtgtcgtgagatgttgggttaagtcccgcaacgagcgcaacccttgtccttagttgccagcgagtaaagtcgggaactctaaggagactgccggtgacaaaccggaggaaggtggggatgacgtcaagtcatcatggcccttacggccagggctacacacgtactacaatggtcggtacagagggttgcgataccgcgaggtggagctaatcccagaaagccgatcccagtccggattggagtctgcaactcgactccatgaagtcggaatcgctagtaatcgcagatcagctatgctgcggtgaatacgttcccgggccttgtacacaccgcccgtcacaccatgggagtgagctgctccagaagccgttagtctaaccgcaagggggacgacgaccacggagtgtttcatgactggggtgaagtc

SEQ ID NO: 216 - DNA, 657 bp, Pseudomonas fluorescens; identical to SEQ ID NO: 181

SEQ ID NO: 217 - DNA, 626 bp, Pantoea vagans
cttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggttcggtcgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttac

SEQ ID NO: 218 - DNA, 656 bp, Stenotrophomonas maltophilia
cttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctggtcttgacatccacagaacttagcagagatgctttggtgccttcgggaactgtgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgaccagggctacacacgtgctacaatggcatatacaaagagaagcgacctcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtc

SEQ ID NO: 219 - DNA, 656 bp, Pantoea agglomerans
ttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggccttgacatgtcgagaactttccagagatggattggtgccttcgggaactcgaacacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacggccagggctacacacgtactacaatggtagggacagagggctgcaagccggcgacggtaagccaatcccagaaaccctatctcagtccggattggagtctgcaactcgactccatgaagtcggaatcgctagtaatcgcagatcatcattgctgcggtgaatacgttcccgggccttgtacacaccgcccgtcacaccatgggagtttgttgcaccagaagcaggtagcttaaccttcgggagggcgcttgccacggtgtggccgatgactggggtgaagtc

SEQ ID NO: 220 - DNA, 655 bp, Burkholderia phytofirmans
tttggcacgcagaatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggccttgacatgtcgagaactttccagagatggattggtgccttcgggaactcgaacacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacggccaggggctacacacgtactacaatggtagggacagagggctgcaagcccggcgacggtaagccaatcccataaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaaagcaggtagcttaaccttcgggagggcgcttgccacggtgtgccgatgactggggtga

SEQ ID NO: 221 - DNA, 657 bp, Burkholderia phytofirmans
tttggcacgcagaatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggccttgacatgtcgagaactttccagagatggattggtgccttcgggaactcgaacacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacggccagggctacacacgtactacaatggtagggacagagggctgcaagccggcgacggtaagccaatcccagaaaccctatctcagtccggattggagtctgcaactcgactccatgaagtcggaatcgctagtaatcgcagatcagcattgctgcgatgaatacgttcccgggccttgtacacaccgcccgtcacaccatgggagtttgttgcaccagaagcaggtagcttaaccttcgggagggcgcttgccacgttgtgcccgatgactggggtgaagtc

SEQ ID NO: 222 - DNA, 657 bp, Streptomyces sp.
tttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggccttgacatgtcgagaactttccagagatggattggtgccttcgggaactcgaacacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacggccagggctacacacgtactacaatggtagggacagagggctgcaagccggcgacggtaagccaatcccagaaaccctatctcagtccggattggagtctgcaactcgactccatgaagtcggaatcgctagtaatcgcagatcagcattgctgcggtgaatacgttcccgggtcttgtacacaccgcccgtcacaccatgggagtttgttgcaccagaagcaggtagtttacccttcgggagggcgcttgcctcggtgtggccgatgactgggctgaagtc

SEQ ID NO: 223 - DNA, 657 bp, Methylobacterium brachiatum; identical to SEQ ID NO: 181

SEQ ID NO: 224 - DNA, 626 bp, Paenibacillus sp.; identical to SEQ ID NO: 214

SEQ ID NO: 225 - DNA, 656 bp, Pantoea agglomerans
ttggcacgcagaatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggccttgacatgtcgagaactttccagagatggattggtgccttcgggaactcgaacacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacggccagggctacacacgtactacaatggtagggacagagggctgcaagccggcgacggtaagccaatcccagaaaccctatctcagtccggattggagtctgcaactcgactccatgaagtcggaatcgctagtaatcgcagatcagcattgctgcggtgaatacgttcccgggcccttgtacacaccgcccgtcacaccatgggagtttgttgcaccagaagcaggtagcttacccttcgggagggcgcttgccacggtgtggccgatgactgggtgaagtc

SEQ ID NO: 226 - DNA, 469 bp, Luteibacter sp.
cttgaggcgtggcttccggagctaacgcgttaagtcgaccgcctggggagtacggccgcaaggttaaaactcaaatgaattgacgggggcccgcacaagcggtggaacatgtggtttaattcgatgcaacgcgaaaaaccttacctactcttgacatccacagaacttatcagaaatgctttggtgccttcgggaactctgagacaggtgctgcatggctgtcgtccgctcgtgttgtgaaatgttgggttaagtcccgcaacgagcgcaacccttatcctttgttgccagcggtcaggccgggaactctcaggagactgccagtgataaactggaggaaggtggggatgacatcaagtcatcatgggccttacaagtagggctacacacgtgctacaatggcgcatacaaagagaagcgacctcccgagagcaagcggacctcataaagtgcgtcttactccggattg

SEQ ID NO: 227 - DNA, 658 bp, Stenotrophomonas maltophilia
atttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggccttgacatgtcgagaactttccagagatggattggtgccttcgggaactcgaacacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacggccagggctacacacgtactacaatggtagggacagagggctgcaagccggcgacggtaagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgcttgccacggtgtggccgatgactggggtgaagtc

SEQ ID NO: 228 - DNA, 654 bp, Pantoea dispersa
tccgccctttagtgctgcagtaacgcattaagcactccgcctggggagtacggtcgcaagattgaaactcaaaggaattgacgggggcccgcacaagcgtggagcatgtggtttaattcgaagcaacgggaagaaccttaccaggtcttgacatcctctgacaactctagagatagagcgttccccttcgggggacagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatggtacaaagggctgcaagaccgcgagtccaagccaatcccataaaaccattctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggagtaaccgtaaggagctagccgcctaaggtggacagatgattgggtgaagtcgt

SEQ ID NO: 229 - DNA, 651 bp, Klebsiella sp.
aggatgctgtggttggcgaagctaacgcgataaacgtaccgcctgggaagtacggccgcaaggttgaaactcaaaggaattgacgggggcccgcacaagcggtggagcatgtggtttaattcgaagcaacgcgaagaaccttaccaggtcttgacatgctaggaactcttgagagatcaggaggtgcccttcggggaacctagacacaggtgctgcatggctgtcgtcagctcgtgtcgtgagatgttgggttaagtcccgcaacgagcgcaacccttacctttagttgccagcattgagttgggcactctagagggactgcctatgaaagtaggaggaaggcggggatgacgtctagtcagcatggtccttacgacctgggctacacacgtgctacaatggatgggacaacgcgcagccaacttgcgaaagtgagcgaatcgctgaaacccatccccagttcagatcggagtctgcaactcgactccgtgaagttggaatcgctagtaatcgcaggtcagcatactgcggtgaatacgttcccgggccttgtacacaccgcccgtcacaccatgggagtaaattgcagctgaaaccgccgggagcctcacggcaggcgtctaggctgtggttcatgactggggtgaagtc

SEQ ID NO: 230 - DNA, 659 bp, Stenotrophomonas maltophilia
gcatgcacttcggtgtcgccgctaacgcattaagcattccgcctggggagtacggccgcaaggttaaaactcaaaggaattgacgggggcccgcacaagcgtggagcatgtggtttaattcgaagcaacgggaagaaccttaccaacccttgacatgtccactatgagtgagagagatcacactcttcggttcggccgggtggaacacaggtgctgcatggctgtcgtcagctcgtgtcgtgagatgttgggttaagtcccgcaacgagcgcaacccctaccgtcagttgccatcattcagttgggcactctggtggaaccgccggtgacaagccggaggaaggcggggatgacgtcaagtcctcatggcccttatgggttgggctacacacgtgctacaatggcggtgacagtgggacgcgaagtcgcgagatggagcaaatccccaaaagccgtctcagttcggatcgtactctgcaactcgagtgcgtgaagttggaatcgctagtaatcgcggatcagcacgccgcggtgaatacgttcccgggccttgtacacaccgcccgtcacaccatgggagttggctttacccgaagacggtgcgctaaccagcaatggaggcagccggccacggtaaggtcagcgactggggtgaagtc

SEQ ID NO: 231 - DNA, 614 bp, Stenotrophomonas maltophilia
tccacgggatctgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggtttgacatacaccggaaaaccgtagagatacggtcccccttgtggtcggtgtacaggtggtgcatggctgtcgtcagctcgtgtcgtgagatgttgggttaagtcccgcaacgagcgcaacccttgtcttatgttgccagcacgtaatggtggggactcgtaagagactgccggggtcaactcggaggaaggtggggacgacgtcaagtcatcatgccccttatgtccagggcttcacacatgctacaatggccagtacagagggctgcgagaccgtgaggtggagcgaatcccttaaagctggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggcctaaccccttg

SEQ ID NO: 232 - DNA, 658 bp, Stenotrophomonas maltophilia
tccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatacacgagaacaccctagaaataggggactctttggacactcgtgaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcccaacccttgtggagggagccgtcgaaggtgggatcggtaattaggactaagtc

SEQ ID NO: 233 - DNA, 654 bp, Stenotrophomonas maltophilia
ttccgccccttagtgctgcagtaacgcattaagcactccgcctggggagtacggtcgcaagactgaaactcaaaggaattgacgggggcccgcacaagcgttggagcatgtggtttaattcgaagcaacggaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccgaaggtgggacagatgattggggtgaagtc

SEQ ID NO: 234 - DNA, 652 bp, Stenotrophomonas maltophilia
tccgccccttagtgctgcagtaacgcattaagcactccgcctggggagtacggtcgcaagattgaaactcaaaggaattgacgggggcccgcacaagcggggagcatgtggtttaattcgaagcaacgggaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtgggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcgtgaatacgttcccgggccttgtacacaccgcccgtcacaccacgagagtttgtaacacccgaagtcggtgaggtaaccttttaggagccagccgccgaagtgggacagatgattggggtgaagtc

SEQ ID NO: 235 - DNA, 304 bp, Pantoea agglomerans
cggtgacaaaccggaggaaggtggggatgacgtcaaatcatcatgccccttatgacctgggctacacacgtgctacaatggatggtacaaagagcagcaaacccgcgagggctagcaaatctcataaagccattctcagtttggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtgaggtaaccttttggaccagccggc

SEQ ID NO: 236 - DNA, 622 bp, Stenotrophomonas maltophilia
gcttgcacctcagtagcgcagctaacgctttgagcattccgcctggggagtacggtcgcaagattaaaactcaaaggaattgacgggggcccgcacaagcggtggagcatgtggtttaattcgaagcaacgcgcagaaccttaccatcctttgacatggcgtgttatggggagagattcccagtcctcttcggaggcgcgcacacaggtgctgcatggctgtcgtcagctcgtgtcgtgagatgttgggttaagtcccgcaacgagcgcaacccacgtccttagttgccatcattcagttgggcactctagggagactgccggtgataagccgcgaggaaggtgtggatgacgtcaagtcctcatggcccttacgggatgggctacacacgtgctacaatggcggtgacagtgggacgcgaaggggcgacctggagcaaatccccaaaagccgtctcagttcggattgcactctgcaactcgggtgcatgaaggcggaatcgctagtaatcgtggatcagcatgccacggtgaatacgttcccgggccttgtacacaccgcccgtcacaccatgggagttggtcttacccgacggcgctgcgccaaccgcaaggggcaggcg

SEQ ID NO: 237 - DNA, 623 bp, Enterobacter asburiae
tttactcactagtggcgcagctaacgctttaagcattccgcctggggagtacggtcgcaagattaaaactcaaaggaattgacgggggcccgcacaagcggtggagcatgtggtttaattcgacgcaacgcgcagaaccttaccagcccttgacatgtccaggaccggtcgcagagatgtgaccttctcttcggagcctggaacacaggtgctgcatggctgtcgtcagctcgtgtcgtgagatgttgggttaagtcccgcaacgagcgcaacccccgtccttagttgctaccatttagttgagcactctaaggagactgccggtgataagccgcgaggaaggtggggatgacgtcaagtcctcatggcccttacgggctgggctacacacgtgctacaatggcggtgacaatgggatgctaaggggcgacccttcgcaaatctcaaaaagccgtctcagttcggattgggctctgcaactcgagcccatgaagttggaatcgctagtaatcgtggatcagcacgccacggtgaatacgttcccgggccttgtacacaccgcccgtcacaccatgggagttggttttacctgaagacggtgcgctaaccgcaaggaggcagcc

SEQ ID NO: 238 - DNA, 599 bp, Stenotrophomonas maltophilia
  modified_base (4)..(4): a, c, t or g
  modified_base (120)..(120): a, c, t or g
  modified_base (122)..(122): a, c, t or g
agantgaaactcaaaggaattgacggggacccgcacaagcagtggagtatgtggtttaattcgaagcaacgcgaagaaccttaccaggtcttgacatccaactaacgaggcagagatgcntnaggtgcccttcggggaaagttgagacaggtggtgcatggttgtcgtcagctcgtgtcgtgagatgttgggttaagtcccgcaacgagcgcaacccttatatttagttgccagcacttcgggtgggcactctagatagactgccggtgacaaaccggaggaaggtggggatgacgtcaaatcatcatgccccttatgacctgggctacacacgtactacaatggccggtacaacgggaagcgaaatcgcgagatggagccaatcccaacaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaaccgcaaggagccagccgccgaaggtgggatagatgattggggtgaagt

SEQ ID NO: 239 - DNA, 598 bp, Bacillus megaterium
  modified_base (119)..(121): a, c, t or g
gactgaaactcaaaggaattgacggggacccgcacaagcagtggagtatgtggtttaattcgaagcaacgcgaagaaccttaccaggtcttgacatccctctgaccggtctagagatannnctttccttcgggacagaggagacaggtggtgcatggttgtcgtcagctcgtgtcgtgagatgttgggttaagtcccgcaacgagcgcaacccttatgcttagttgccagcaggtcaagctgggcactctaagcagactgccggtgacaaaccggaggaaggtggggatgacgtcaaatcatcatgccccttatgacctgggctacacacgtactacaatggccggtacaacgggaagcgaaatcgcgaggtggagccaatcctagaaaagccggtctcagttcggattgtaggctgcaactcgcctacatgaagtcggaattgctagtaatcgcggatcagcatgccgcggtgaatacgttcccgggtcttgtacacaccgcccgtcacaccacgagagtttacaacacccgaagtcggtggggtaacccgcaagggagccagccgccgaaggtggggtagatgattggggtgaagt

SEQ ID NO: 240 - DNA, 628 bp, Deinococcus grandis
gcaataagcactccgcctggggagtacgctcgcaagagtgaaactcaaaggaattgacgggggcccgcacaagcggtggagcatgtggtttaattcgaagcaacgcgaagaaccttaccaggtcttgacatcccgctgaccgctctggagacagagcttcccttcggggcagcggtgacaggtggtgcatggttgtcgtcagctcgtgtcgtgagatgttgggttaagtcccgcaacgagcgcaacccttatctttagttgccagcattcagttgggcactctagagagactgccgtcgacaagacggaggaaggcggggatgacgtcaaatcatcatgccccttatgacctgggctacacacgtgctacaatggttggtacaacgggaagctacctcgcgagaggacgccaatctcttaaaaccaatctcagttcggattgtaggctgcaactcgcctacatgaagtcggaatcgctagtaatcgcggatcagcatgccgcggtgaatacgttcccgggccttgtacacaccgcccgtcacaccacgggagtttgcaacacccgaagtcggtgaggtaaccgcaaggagccagccgccgaaggtggggtagatgactggggtgaagt

SEQ ID NO: 241 - DNA, 565 bp, Azospirillum zea
  modified_base (37)..(37): a, c, t or g
aaactcaaatgaattgacgggggcccgcacaagcggnggagcatgtggtttaattcgatgcaacgcgaagaaccttacctggccttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactt

SEQ ID NO: 242 - DNA, 565 bp, Rhodococcus fascians
  modified_base (103)..(105): a, c, t or g
aaactcaaatgaattgacgggggcccgcacaagcggtggagcatgtggtttaattcgatgcaacgcgaagaaccttacctactcttgacatccagagaacttnnnagagatgctttggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactt

SEQ ID NO: 243 - DNA, 314 bp, Microbacterium sp.
gcattaagtaatccacctgggaagtacgaccgcaaggttgaaactcaaaggaattggcgggggtccgcacaagcggaggagcatgtggtttaattcgatgatacgcgaggaaccttacctgggctagaatgcagtctgaccgtggagaaaagctcatttcgtagctctacgcagattgtaaggtgctgcatggttgtcgtcacctcgcgccgtgaggtgttgtgtaagtcccggacgagcgcaaccacgatcattagttgcaagaggtgaagctgggaactctaagtgaaactgccgtcgcagacacgaggagg

SEQ ID NO: 244 - DNA, 342 bp, Bacillus subtilis
gcatacgcactccgcccggggaggacggtcgcaagactgaaactcataggaattgacgggcgcccgcacaagcggtggagcatgtgttttaattcgaagcaacggtagaaccttaccaggtcttgacatcctctgtcgaccctagagatagccctttcccttcggggacagagtgatcggtggtgtgtggttggcgtcagctcgtgtcgggagatgttgggttaagtcccggacgagcgcaattcttgatattagttaccggcattcagttgggcactctaaggtgactgccggagacaacaggaggaggttggcgaggaggcataatcatcctgccctttt

SEQ ID NO: 245 - DNA, 636 bp, Bacillus subtilis
  modified_base (44)..(44): a, c, t or g
  modified_base (46)..(46): a, c, t or g
  modified_base (409)..(409): a, c, t or g
  modified_base (473)..(473): a, c, t or g
  modified_base (616)..(616): a, c, t or g
agctacgcattaagcactccgcctggggagtacggtcgcaagantnaaactcaaaggaattgacgggggcccgcacaagcggggagcatgtggtttaattcgaagcaacgcgaagaaccttaccaggtcttgacatcctctgacaaccctagagatagggctttcccttcggggacagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggacagaacaaagggctgcgagaccgcaagntttagccaatcccacaaatctgttctcagttcggatcgcagtctgcaactcgactgcgtgaagntggaatcgctagtaatcgcggatcagcatgccgcggtgaatacgttcccgggccttgtacacaccgcccgtcacaccacgagagtttgcaacacccgaagtcggtgaggtaacctttatggagccagccgccgaaggtggggncagatgattggggtgaagtc

SEQ ID NO: 246 - DNA, 636 bp, Bacillus asahai
agcaacgcattaagcactccgcctggggagtacggccgcaaggtgaaactcaaaggaattgacgggggcccgcacaagcgggggagcatgtggtttaattcgaagcaacgcgaagaaccttaccaggtcttgacatctcctgacaatcctagagataggacgttccccttcgggggacaggatgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatggtacaaagggcagcaaaaccgcgaggtcgagccaatcccataaaaccattctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaacccttctgggagccagccgcctaaggtgggatagatgattggggtgaag

SEQ ID NO: 247 - DNA, 529 bp, Methylobacterium brachiatum
  modified_base (36)..(36): a, c, t or g
  modified_base (82)..(82): a, c, t or g
  modified_base (132)..(132): a, c, t or g
  modified_base (341)..(341): a, c, t or g
  modified_base (366)..(366): a, c, t or g
  modified_base (462)..(462): a, c, t or g
aactcaaaggaattgacgggggcccgcacaagcggnggagcatgtggtttaattcgaagcaacgcaaagaaccttaccaggncttgacatctcctgacaatcctagagataggacgttccccttcggggganaggatgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatggnacaaagggcagcaaaaccgcgaggncgagccaatcccataaaaccattctcagttcggattgtaggctgcaactcgcctacatgaagctggaatcgctagtaatcgcggatcagcatgccncggtgaatacgttcccgggccttgtacacaccgcccgtcacaccacgagagtttgtaacacccgaag

SEQ ID NO: 248 - DNA, 565 bp, Bradyrhizobium japonicum
  modified_base (147)..(147): a, c, t or g
  modified_base (360)..(360): a, c, t or g
  modified_base (362)..(362): a, c, t or g
  modified_base (399)..(399): a, c, t or g
caaatgaattgacgggggcccgcacaagcggggagcatgtggtttaattcgatgcaacgcaaagaaccttacctggccttgacatccagagaacttagcagagatgctttggtgccttcgggaactctgagacaggtgctgcatggntgtcgtcagctcgtgttgtgaaatgttgggttaagtcccgcaacgagcgcaacccttatcctttgttgccagcggttcggccgggaactcaaaggagactgccggtgataaaccggaggaaggtggggatgacgtcaagtcatcatggcccttacggccagggctacacacgtgctacaatggcgcatacaaagagaagcgacctcgcgagancnaagcggacctcataaagtgcgtcgtagtccggattgnagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtga

SEQ ID NO: 249 - DNA, 637 bp, Paenibacillus sp.
agctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaaccctagagatagggctttcccttcggggacagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggacagaacaaagggctgcgagaccgcaaggtttagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgcaacacccgaagtcggtgaggtaacctttatggagccagccgccgaaggtggggcagatgattggggtgaagtc

SEQ ID NO: 250 - DNA, 584 bp, Paenibacillus polymyxa
gtggcttccggagctaactcgttaagtcgactcgcctggggagtacggccgcaaggttaaaactcaaatgaattgacggggggccgctcaagcggtggagcatgtggtttaattcgatgcaacgcgaagaaccttacctggtcttgacatccacagaactttccagagatggattggtgccttcgggaactgtgagacaggtgctgcatggctgtcgtcagctcgtgttgtgaaatgtagggttaagtcccgcaacgagcgcaacccttatcctttgtttccagcggtccggccgggaactcaaaggagactgccagtgataaactggaggaaggtggggatgacgtcaagtcatcatggcccttacgaccagggctacacacgtgctacaatggcgcatacaaagagaagcaatctcgcgagagctagcggacctcataaagtgcgtcgtagtccggattggagtctgcaactcgactccatgaagtcggaatcgctagtaatcgtgaatcagaatgtcacggtgaatacgttcccgggccttgtacacaccgcccgtcacaccatgggagtgggtgcaaaag

SEQ ID NO: 251 - DNA, 637 bp, Brevibacillus agri
  modified_base (44)..(44): a, c, t or g
  modified_base (84)..(84): a, c, t or g
  modified_base (413)..(413): a, c, t or g
agctaacgcgttaagtcgaccgcctggggagtacggccgcaagnttaaaactcaaatgaattgacgggggcccgcacaagcggnggagcatgtggtttaattcgatgcaacgcgaagaaccttacctggccttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccggtgataaaccggaggaaggtggggatgacgtcaagtcatcatggcccttacggccagggctacacacgtgctacaatggcgcatacaaagagaagcgacctcgcgagancaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtc

SEQ ID NO: 252 - DNA, 633 bp, Pantoea agglomerans
acattaagcattccgcctggggagtacggtcgcaagactgaaactcaaaggaattgacggggacccgcacaagcagtggagtatgtggtttaattcgaagcaacgcgaagaaccttaccaggtcttgacatccctctgaccggtctagagatagacctttccttcgggacagaggagacaggtggtgcatggttgtcgtcagctcgtgtcgtgagatgttgggttaagtcccgcaacgagcgcaacccttatgcttagttgccagcaggtcaagctgggcactctaagcagactgccggtgacaaaccggaggaaggtggggatgacgtcaaatcatcatgccccttatgacctgggctacacacgtactacaatggccggtacaacgggaagcgaagtcgcgaggtggagccaatcctagaaaagccggtctcagttcggattgtaggctgcaactcgcctacatgaagtcggaattgctagtaatcgcggatcagcatgccgcggtgaatacgttcccgggtcttgtacacaccgcccgtcacaccacgagagtttacaacacccgaagtcggtggggtaacccgcaaggaagccagccgccgaaggtggggtagatgattggggtgaagt

SEQ ID NO: 253 - DNA, 565 bp, Enterobacter sp.
ctcaaaggaattgacgggggcccgcacaagcggtggagcatgtggtttaattcgaagcaacgcgaagaaccttaccaggtcttgacatcctttgaccactctagagatagagcttccccttcgggggcaaagtgacaggtggtgcatggttgtcgtcagctcgtgtcgtgagatgttgggttaagtcccgcaacgagcgcaacccttattgttagttgccatcatttagttgggcactctagcgagactgccggtgacaaaccggaggaaggtggggatgacgtcaaatcatcatgccccttatgacctgggctacacacgtgctacaatgggaagtacaacgagttgcgaagtcgcgaggctaagctaatctcttaaagcttctctcagttcggattgtaggctgcaactcgcctacatgaagccggaatcgctagtaatcgcggatcagcacgccgcggtgaatacgttcccgggccttgtacacaccgcccgtcacaccacgagagtttgtaacacccgaagtcggtgaggtaacctttttggagccagccgcctaaggtgg

SEQ ID NO: 254 - DNA, 637 bp, Sediminibacterium sp.
  modified_base (278)..(278): a, c, t or g
agctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcggttnggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtc

SEQ ID NO: 255 - DNA, 638 bp, Bacillus pumilus
  modified_base (18)..(18): a, c, t or g
  modified_base (85)..(85): a, c, t or g
  modified_base (201)..(201): a, c, t or g
  modified_base (398)..(399): a, c, t or g
agctaacgcgttaagtcngaccgcctggggagtacggccgcaaggttaaaactcaaatgaattgacgggggcccgcacaagcggnggagcatgtggtttaattcgatgcaacgcgaagaaccttacctactcttgacatccagagaacttagcagagatgctttggtgccttcgggaactctgagacaggtgctgcatggntgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgagtagggctacacacgtgctacaatggcgcatacaaagagnngcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtc

SEQ ID NO: 256 - DNA, 271 bp, Bacillus pumilus
agctaacgcattaagttccccgcctggggagtacggccgcaaggtaaaactcaaaggaattgacggggacccgcacaagcgggggagttgggaattaattcgatgcaacggaagaactttaccaggctttgccatatacgaaaacgggccagaaatggccacctctttggacactcgtaaacgggtggggcttgtttgtcgccagcccgtgtcgggaaatgttgggttaagtcccgaaacgggcgcaaccctcgttctttgttgccagccc

SEQ ID NO: 257 - DNA, 347 bp, Bacillus circulans
gcttaagtaatccacctggggagtacgaccgcaaggttgaactcaaaggaattggcgggggccgcacaagcgaggagcatgtggtttaattcgatgatacgcgaggaaccttacctgggctagaatgctgtctgaccgtgggaaaagcacatttcgtatcaatacgcagattgtaagctgctgacatggcgtcgtctcctcgtgccgtgagttgttgtgttacgtccagcgacgagcgcaacccctatcattagttgccaagagatgaagctggtaactctagtgaaactgctgccgcaggagaggaggaaggagggatgacggaaatcatcatcttcattatgggg

SEQ ID NO: 258 - DNA, 607 bp, Bacillus nealsonii
gcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagcttccccttcgggggcaaagtgacaggtggtgcatggttgtcgtcagctcgtgtcgtgagatgttgggttaagtcccgcaacgagcgcaacccttattgttagttgccatcatttagttgggcactctagcgagactgccggtgacaaaccggaggaaggtggggatgacgtcaaatcatcatgccccttatgacctgggctacacacgtgctacaatgggaagtacaacgagttgcgaagtcgcgaggctaagctaatctcttaaagcttctctcagttcggattgtaggctgcaactcgcctacatgaagccggaatcgctagtaatcgcggatcagcacgccgcggtgaatacgttcccgggccttgtacacaccgcccgtcacaccacgagagtttgtaacacccgaagtcggtgaggtaacctttttggagccagccgcctaaggtg

SEQ ID NO: 259 - DNA, 622 bp, Pantoea agglomerans; identical to SEQ ID NO: 236

SEQ ID NO: 260 - DNA, 565 bp, Bacillus pumilus
actcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttg

SEQ ID NO: 261 - DNA, 637 bp, Enterobacter sp.; identical to SEQ ID NO: 249

SEQ ID NO: 262 - DNA, 528 bp, Pantoea agglomerans
agctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccggg

SEQ ID NO: 263 - DNA, 636 bp, Paenibacillus polymyxa
  modified_base (44)..(44): a, c, t or g
  modified_base (84)..(84): a, c, t or g
agctaacgcgttaagtcgaccgcctggggagtacggccgcaagnttaaaactcaaatgaattgacgggggcccgcacaagcggnggagcatgtggtttaattcgatgcaacgcgagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtc

SEQ ID NO: 264 - DNA, 629 bp, Enterococcus gallinarum
gcgttaagtcgaccgcctggggagcacggacgcaaggttaaaactcaaatgaattgacgggggcccgcacaagcggtggagcatgtggtttaattcgatgcaacgcgaagaaccttacctactcttgaaatccagagaactttccagagatggattggtgccttcgggaactctgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagt

SEQ ID NO: 265 - DNA, 377 bp, Enterobacter asburiae
  modified_base (128)..(128): a, c, t or g
  modified_base (142)..(142): a, c, t or g
  modified_base (182)..(182): a, c, t or g
  modified_base (309)..(309): a, c, t or g
agctaacgcgataagtcgaccgcctggggagtacggccgcaagattaaaactcaaatgaattgacgggggcccgcacaagcggtggagcatgtggtttaattcgatgcaacgcgaagaaccttacctnctcttgacatccanagaactttccagagatggattggtgccttcgggaactctnatacaggtgctgcatggctgtcgtcagctcgtgttgtgaaatgttgggttaagtcccgcaacgagcgcaacccttatcctttgttgccagcgagtagagccggaacttttaggagactgccaggganaaactggaggaaggtggggatgacgtcaagtcattctggcccttaacagtagggctacccacgtgcta

SEQ ID NO: 266 - DNA, 354 bp, Pantoea agglomerans
gcgataagtcgaccgcctggggagtacggccgcaagattaaaactcaaatgaattgacgggggcccgcacaagcggtggagcatgtggtttaattcgatgcaacgcgaagaaccttacctgctcttgacatccaaagaactttccagagatggattggtgccttcgggaactctgatacaggtgctgcatggctgtcgtcagctcgtgttgtgaaatgttgggttaagtcccgcaacgagcgcaacccttttcctttgttgccagcgagtaatgcgggaaactttaagagaccggccgggaacaaccggaggaaggtggggatgacgtccaggcatccttggcccctaacagca

SEQ ID NO: 267 - DNA, 622 bp, Microbacterium schleiferi; identical to SEQ ID NO: 236

SEQ ID NO: 268 - DNA, 395 bp, Sediminibacterium sp.
ctcttacacaggtgctgcatggctgtcgtcagctcgagttgtgaaatttagggttaagtcccgcaacgagcgcaacccttatcctttttttccagcggttcggtcgggatctcaaacgagactgccactgataaactggaggaaggtggggatgacggcaagtcatcatgccccttccgagtagggctacccccgtgctacaatggccagtacaaagagaagcgacctcgcgagagcaagcggacctcataaagtgcgtcgtagtcccgagtggagtctgcaactcgactccatgaagtcggaatcgctagtaatcgtagatcagaatgctccggtgaatacgttcccgggccttgtacacacccaccgtcccaccatgggagtgggtgcaaaag

SEQ ID NO: 269 - DNA, 330 bp, Enterococcus gallinarum
  modified_base (89)..(89): a, c, t or g
  modified_base (161)..(161): a, c, t or g
  modified_base (201)..(201): a, c, t or g
  modified_base (261)..(261): a, c, t or g
  modified_base (295)..(295): a, c, t or g
agctgaaagcattgagcactccgtctggagagtaggggcgcgagattaactctcagagaatttgacggacccccgcaaaagcgggatantgtgttttttaactctaagcaacgaaaaaccttatacacgttcgagacatcctctgattgccatagagatantactttcccttcgagaacagagacacaggtgctgcatggntgtcgtcagctcgtgtcgtgagatgttgggttaagtcccgcaacgagcgcaacccttgtncttagttgctagattttggttgggccctttatgnggactgcggggaaaaaacggaggaaggtggggata

SEQ ID NO: 270 - DNA, 723 bp, Methylobacterium brachiatum
atccaaaactggcaagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttctagagatagattggtgccttcgggaacattgagacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgcga

SEQ ID NO: 271 - DNA, 792 bp, Enterobacter cloacae
ggcgtaaagcgtgcgtaggtggtcgtttaagtctgttgtgaaagccctgggctcaacctgggaactgcagtggaaactggacgactagagtgtggtagagggtagcggaattcctggtgtagcagtgaaatgcgtagagatcaggaggaacatccatggcgaaggcagctacctggaccaacactgacactgaggcacgaaagcgtggggagcaaacaggattagataccctggtagtccacgccctaaacgatgcgaactggatgttgggtgcaatttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggccttgacatgtcgagaactttccagagatggattggtgccttcgggaactcgaacacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacggccagggctacacacgtactacaatggtagggacagagggctgcaagccggcgacggtaagccaatcccagaaaccctatctcagtccggattggagtctgcaactcgactccatgaagtcggaatcgctagtaatcgcag

SEQ ID NO: 272 - DNA, 663 bp, Bacillus pumilus
aatgcgtagagatcaggaggaacatccatggcgaaggcagctacctggaccaacactgacactgaggcacgaaagcgtggggagcaaacaggattagataccctggtagtccacgccctaaacgatgcgaactggatgttgggtgcaatttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggccttgacatgtcgagaactttccagagatggatcggtgccttcgggaactcgaacacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacggccagggctacacacgtactacaatggtagggacagagggctgcaagccggcgacggtaagccaatcccagaaaccctatctcagtccggattggagtctgcaactcgactccatgaagtcggaatcgctagtaatcgca

SEQ ID NO: 273 - DNA, 741 bp, Enterobacter cloacae
gaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgcta

SEQ ID NO: 274 - DNA, 755 bp, Enterobacter cloacae
gtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgtcggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcctttagttgccatcatttagttgggcactctaaagggactgccagtgataagctggaggaaggtggggatgacgtcaagtcctcatggcccttacgggctgggctacacacgtgctacaatggtggtgacagtgggcagcaagcacgcgagtgtgagctaatctccaaaagccatctcagttcggattgcactctgcaactcgagtgcatgaagttggaatcgctagtaatc

SEQ ID NO: 275 - DNA, 720 bp, Enterobacter cloacae
ttgaaactagatagcttgaatccaggagaggtgagtggaattccgagtgtagaggtgaaattcgtagatattcggaagaacaccagtggcgaaggcggctcactggactggtattgacgctgaggtgcgaaagcgtggggagcaaacaggattagataccctggtagtccacgccgtaaacgatgataactagctgtcagggcacatggtgttttggtggcgcagctaacgcattaagttatccgcctggggagtacggtcgcaagattaaaactcaaaggaattgacgggggcctgcacaagcggtggagcatgtggtttaattcgaagcaacgcgcagaaccttaccaacgtttgacatccctatcgcggatcgtggagacactttccttcagttcggctggataggtgacaggtgctgcatggctgtcgtcagctcgtgtcgtgagatgttgggttaagtcccgcaacgagcgcaaccctcgcctttagttgccagcatttagttgggtactctaaaggaaccgccggtgataagccggaggaaggtggggatgacgtcaagtcctcatggcccttacgcgttgggctacacacgtgctacaatggcgactacagtgggcagccacctcgcgagagggagctaatctccaaaagtcgtctcagttcggatcgttctctgcaactcgagagcgtgaaggcggaatcgctagtaatcgc

SEQ ID NO: 276 - DNA, 618 bp, Enterobacter hormaechei
attgcgaaggcaggttactactaatggattgacgctgatggacgaaagcgtgggtagcgaacaggattagataccctggtagtccacgccgtaaacgatggatactagctgttggaagcaatttcagtggctaagcgaaagtgataagtatcccacctggggagtacgaacgcaagtttgaaactcaaaggaattgacgggggcccgcacaagcggtggagcatgtggtttaattcgatgatacgcgaggaaccttaccaaggcttaaatgcagactgaccgatttggaaacagatctttcgcaagacagtttacaaggtgctgcatggttgtcgtcagctcgtgccgtgaggtgtcaggttaagtcctataacgagcgcaacccctgttgttagttgccagcgagtagtgtcgggaactctaacaagactgccagtgcaaactgtgaggaaggtggggatgacgtcaaatcatcacggcccttacgccttgggctacacacgtgctacaatggccggtacagagagcagccactgggcgaccaggagcgaatctataaagccggtcacagttcggatcggagtctgcaactcgactccgtgaagctggaatcgctag

SEQ ID NO: 277 - DNA, 585 bp, Pantoea sp.
gaggcgcgaaagcgtggggagcaaccaggattagataccctggtagtccacgccgtaaacgatgaatgctaggtgttaggggtttcgatacccttggtgccgaagttaacacattaagcattccgcctggggagtacgctcgcaagagtgaaattcaaaggaattgacggggacccgcccaagcagtggagtatgtggtttaattggaagcaacgcgaagacccttaccagctcttgacatttgagtgaaagcaccagagatggtgccctttttcggaacactcaagccaggtggtgcatggttgtcgtcagctcgtgtcgtgagatgttgggttaagtcccgcaacgagcccaccccttgattttagttgccagcacttcgggtgggcactctaaggtgactgccggtgacaaaccggaggaaggtggggatgacgtcaaatcatcatgccccttatgagctgggctacacacgtactacaatggccggtacaacgggaagcgaaaccgcgaggtggagccaatcctatcaaagccggtctcagttcggattgcaggctgcaactcgcctgcatgaagtcggaa

SEQ ID NO: 278 - DNA, 677 bp, Methylobacterium brachiatum
ggggtagcggtggaatgcgcagatatcaggaggaacaccgatggcgaaggcaggtctctgggcacttactgacgctgaggagcgaaagcgtggggagcgaacaggattagataccctggtagtccacgccgtaaacgttgggcgctagatgtggggacctttccacggtttccgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacacgagaacgggccagaaatggtcaactctttggacactcgtgaacaggtggtgcatggttgtcgtcagctcgtgtcgtgagatgttgggttaagtcccgcaacgagcgcaaccctcgtcgcatgttgccagcacgttatggtggggactcatgtgagactgccggggtcaactcggaggaaggtggggatgacgtcaaatcatcatgccccttatgtcttgggcttcacgcatgctacaatggccggtacaaagggctgcgatgtcgtaaggcggagcgaatcccaaaaagccggtctcagttcggattgaggtctgcaactcgacctcatgaagtcggagtcgctagtaatcgcag

SEQ ID NO: 279 - DNA, 721 bp, Enterobacter asburiae
cagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggtcgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacg

SEQ ID NO: 280 - DNA, 800 bp, Bacillus pumilus
aattattgggcgtaaagagctcgtagggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcatggggagcgaacaggattagataccctggtagtccatgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggtcgcccccttgtggtcggtgtacaggtggtgcatggttgtcgtcagctcgtgtcgtgagatgttgggttaagtcccgcaacgagcgcaaccctcgttctatgttgccagcgggttatgccggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcag

SEQ ID NO: 281 - DNA, 719 bp, Pseudomonas protegens
ggtacgggcagactagagtgcggtaggggagattggaattcctggtgtagcggtggaatgcgcagatatcaggaggaacaccgatggcgaaggcagatctctgggccgtaactgacgctgaggagcgaaagcatggggagcgaacaggattagataccctggtagtccatgccgtaaacgttgggaactagatgtgggggccattccacggtctccgtgtcgcagctaacgcattaagttccccgcctggggagtacggccgcaaggctaaaactcaaaggaattgacgggggcccgcacaagcggcggagcatgcggattaattcgatgcaacgcgaagaaccttaccaaggcttgacatataccggaaacgtccagagatggtcgccccgcaaggtcggtatacaggtggtgcatggttgtcgtcagctcgtgtcgtgagatgttgggttaagtcccgcaacgagcgcaaccctcgttctatgttgccagcacgtttatggtgggaactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcag

SEQ ID NO: 282 - DNA, 798 bp, Stenotrophomonas maltophilia
tttattgggcgtaaagagctcgtaggcggtttgtcgcgtctgctgtgaaatcccgaggctcaacctcgggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggaccattccacggtttccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcgataccgtgaggtggagcgaatcccaaaaagccggtcccagttcggattgaggtctgcaactcgacctcatgaagtcggagtcgctagtaatcgca

SEQ ID NO: 283 - DNA, 575 bp, Stenotrophomonas maltophilia
ccggtggcgaaggcgggtctctgggcagtaactgacgctgaggagcgaaagcgtgggtagcgaacaggattagataccctggtagtccacgccgtaaacggtgggtactaggtgtgggtttccttccttgggatccgtgccgtagctaacgcattaagtaccccgcctggggagtacggtcgcaagactaaaactcaaaggaattgacgggggcccgcacaagcggcggagcatgtggattaattcgatgcaacgcgaagaaccttacctgggtttgacatgcacaggacgtacctagagataggtattcccttgtggcctgtgtgcaggtggtgcatggctgtcgtcagctcgtgtcgtgagatgttgggttaagtcccgcaacgagcgcaacccttgtcctatgttgccagcgggtaatgccggggactcgtaggagactgccggggtcaactcggaggaaggtggggatgacgtcaagtcatcatgccccttatgtccagggcttcacacatgctacaatggccagtacagagggctgcgaaccgcaaggtggagcgaatcccttaaagctg

SEQ ID NO: 284 - DNA, 624 bp, Ochrobactrum tritici
ttgggcagtaactgacgctgaggagcgaaagcgtgggtagcgaacaggattagataccctggtagtccacgccgtaaacggtgggtactaggtgtgggtttccttccttgggatccgtgccgtagctaacgcattaagtaccccgcctggggagtacggtcgcaagactaaaactcaaaggaattgacgggggcccgcacaagcggcggagcatgtggattaattcgatgcaacgcgaagaaccttacctgggtttgacatgcacaggacgtacctagagataggtattcccttgtggcctgtgtgcaggtggtgcatggctgtcgtcagctcgtgtcgtgagatgttgggttaagtcccgcaacgagcgcaacccttgtcctatgttgccagcgggtaatgccggggactcgtaggagactgccggggtcaactcggaggaaggtggggatgacgtcaagtcatcatgccccttatgtccagggcttcacacatgctacaatggccagtacagagggctgcgaagccgcaaggtggagcgaatcccttaaagctggtctcagttcggattggggtctgcaactcgaccccatgaagtcggagtcgctagtaatcgcagatcag

SEQ ID NO: 285 - DNA, 630 bp, Ochrobactrum grignonense
ggcagatctctgggccgctactgacgctgaggagcgaaagggtggggagcaaacaggcttagataccctggtagtccaccccgtaaacgttgggcgctagatgtggggaccattccacggtttccgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggacgacgtcaaatcatcatgccccttatgtcttgggcttcacgcatgctacaatggccagtacaaagggctgcaataccgtaaggtggagcgaatcccaaaaagctggtcccagttcggattgaggtctgcaactcgacctcatgaagtcggagtcgctagtaatcgcaga

SEQ ID NO: 286 - DNA, 381 bp, Sphingomonas yanoikuyae
acgcgaagaaccttacctggtcttgacatccacagaagtttccagagatgggaatgtgccttcgggaactgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagta

SEQ ID NO: 287 - DNA, 380 bp, Flavobacterium johnsoniae
aacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggccagggctacacacgtgctacaatggtcggtacaaagggttgccaaaccgcgaggtggagctaatcccataaaaccgatcgtagtccggatcgcagtctgcaactcgactgcgtgaagtcggaatcgcta

SEQ ID NO: 288 - DNA, 373 bp, Paenibacillus humicus
aagaaccttacctggccttgacatgtctggaatcctgcagagatgcgggagtgccttcgggaatcagaacacaggtgctgcatggctgtcgtcagctcgtgtcgtgagatgttgggttaagtcccgcaacgagcgcaacccctgtcctttgttgccagcacgtaatggtgggaactcaagggagactgccggtgataaaccggaggaaggtggggatgacgtcaagtcatcatggcccttacggccagggctacacacgtgctacaatggcgcgtacaaagggctgcaagctagcgatagtgagcgaatcccagaaagcgcgtcgtagtccggattggagtctgcaactcgactccatgaagtcggaatcgct

SEQ ID NO: 289 - DNA, 350 bp, Agromyces mediolanus
aacgcgaagaaccttacctacccttgacatggtcggaatcctgaagagatttgggagtgctcgaaagagaaccggcgcacaggtgctgcatggctgtcgtcagctcgtgtcgtgagatgttgggttaagtcccgcaacgagcgcaacccttgtcattagttgttacgaaagggcactctaatgagactgccggtgacaaaccggaggaaggtggggatgacgtcaagtctctcatggcccttatgggtagggcttcacacgtcatacaatggtacatacagagggccgccaacccgcgagggggagctaatcccagaaagtgtatcgtagtccggattgtagtctgcaat

SEQ ID NO: 290 - DNA, 382 bp, Curtobacterium citreum
aacgcgaagaaccttacctggtcttgacatagtaagaactttccagagatggattggtgccttcgggaacttacatacaggtgctgcatggctgtcgtcagctcgtgtcgtgagatgttgggttaagtcccgcaacgagcgcaacccttttccttatttgccagcgggttaagccgggaactttaaggatactgccagtgacaaactggaggaaggcggggacgacgtcaagtcatcatggcccttacgaccagggctacacacgtgctacaatggtcggtacaaagggttgctacctagcgataggatgctaatctcaaaaagccgatcgtagtccggattggagtctgcaactcgactccatgaagtcggaatcgctagt

SEQ ID NO: 291 - DNA, 382 bp, Curtobacterium herbarum
aacgcgaagaaccttaccagctcttgacattcggggtatgggcattggagacgatgtccttcagttaggctggccccagaacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagacagcgatgtcgagctaatctccaaaagccatctcagttcggattgcactctgcaactcgagtgcatgaagttggaatcgcta

SEQ ID NO: 292 - DNA, 376 bp, Frigoribacterium faeni
aacgcgaagaaccttacctggtcttgacatccacagaacttggcagagatgccttggtgccttcgggaactgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcg

SEQ ID NO: 293 - DNA, 382 bp, Microbacterium oleivorans
aacgcgaagaaccttacctggtcttgacatccacggaagttttcagagatgagaatgtgccttcgggaaccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagta

SEQ ID NO: 294 - DNA, 383 bp, Mycobacterium abscessus
aacgcgaagaaccttacctggccttgacatgtcgagaactttccagagatggatcggtgccttcgggaactcgaacacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacggccagggctacacacgtactacaatggtagggacagagggctgcaagccggcgacggtaagccaatcccagaaaccctatctcagtccggattggagtctgcaactcgactccatgaagtcggaatcgctagta

SEQ ID NO: 295 - DNA, 380 bp, Mycobacterium abscessus
aacgcgaagaaccttacctactcttgacatccacggaatttggcagagatgccttagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctag

SEQ ID NO: 296 - DNA, 375 bp, Plantibacter  flavus
aagaaccttacctggtcttgacatgtacggaatcctccagagacggaggagtgccttcgggagccgtaacacaggtgctgcatggctgtcgtcagctcgtgtcgtgagatgttgggttaagtcccgcaacgagcgcaacccttgtcattagttgccatcatttagttgggcactctaatgagactgccggtgacaagccggaggaaggtggggatgacgtcaagtcctcatggcccttatgaccagggcttcacacgtcatacaatggtcggtacagagggtagccaagccgcgaggtggagccaatctcacaaaaccgatcgtagtccggattgcactctgcaactcgagtgcatgaagtcggaatcgctagta

SEQ ID NO: 297 - DNA, 378 bp, Enterobacter cloacae subsp. cloacae
aagaaccttaccaggccttgacatccaatgaactttctagagatagattggtgccttcgggaacattgagacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacaaagggttgccaagccgcgaggtggagctaatcccataaaaccgatcgtagtccggatcgcagtctgcaactcgactgcgtgaagtcggaatcgctagtaa

SEQ ID NO: 298 - DNA, 373 bp, Pseudomonas oryzihabitans
aacgcgaagaaccttacctggccttgacatgtccggaatcctgcagagatgcgggagtgccttcgggaatcggaacacaggtgctgcatggctgtcgtcagctcgtgtcgtgagatgttgggttaagtcccgcaacgagcgcaacccttgtccttagttgccagcacgtaatggtgggaactctaaggagactgccggtgacaaaccggaggaaggtggggatgacgtcaagtcatcatggcccttacggccagggctacacacgtactacaatggtcggtacagagggttgcaataccgcgaggtggagccaatcccagaaagccgatcccagtccggatcgaagtctgcaactcgacttcgtgaagtcgga

SEQ ID NO: 299 - DNA, 378 bp, Aeromonas hydrophila subsp. dhakensis
aacgcgaagaaccttaccaggccttgacatgcagagaactttccagagatggattggtgccttcgggaactctgacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatctcacaaaaccgatcgtagtccggatcgcagtctgcaactcgactgcgtgaagtcggaatcgc

SEQ ID NO: 300 - DNA, 380 bp, Herbaspirillum rubrisubalvicans
aacgcgaagaaccttaccaggtcttgacatcctctgacaaccctagagatagggccttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagagcccgcaaacccgcgagggtaagctaatctcataaagccattctcagttcggattgcaggctgcaactcgcctgcatgaagccggaatcgct

SEQ ID NO: 301 - DNA, 379 bp, Acinetobacter beijerinckii
aacgcgaagaaccttaccaggtcttgacatccatggaactcctgagagatcaggaggtgcccttcggggagccatgagacaggtgctgcatggctgtcgtcagctcgtgtcgtgagatgttgggttaagtcccgcaacgagcgcaacccttgcctttagttgtcagcattcagttggacactctagagggactgcctatgaaagtaggaggaaggcggggatgacgtctagtcagcatggtccttacgacctgggctacacacgtgctacaatggatgggacaacgcgctgccagcctgcgaaggtgcgcgaatcgctgaaacccatccccagttcagatcggagtctgcaactcgactccgtgaagttggaatcgcta

SEQ ID NO: 302 - DNA, 374 bp, Rhizobium radiobacter
aacgcgaagaaccttacctacccttgacatgtctggaattcctaagagattgggaagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggattgcaggctgcaactcgcctgcatgaagtcggaatcgct

SEQ ID NO: 303 - DNA, 730 bp, Enterobacter arachidis
aacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttggcagagatgctttggtgccttcgggaactctgagacaggtgctgcatggctgtcgtcagctcgtgttgtgaaatgttgggttaagtcccgcaacgagcgcaacccctatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtagatcagaatgctacggtgaatacgttcccgggccttgtacacaccgcccgtcacaccatgggagtgggttgcaaaagaagtagatagcttaaccttcgggagggcgtttaccactttgtgattcatgactggggtgaagtcgtaacaaggtaacc

SEQ ID NO: 304 - DNA, 729 bp, Escherichia coli
aacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggcgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtagatcagaatgctacggtgaatacgttcccgggccttgtacacaccgcccgtcacaccatgggagtgggttgcaaaagaagtagtagcttaaccttcgggagggcgcttaccactttgtgattcatgactggggtgaagtcgtaacaaggtaacc

SEQ ID NO: 305 - DNA, 730 bp, Stenotrophomonas maltophilia
aacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccagagaacttagcagagatggattggtgccttcgggaactgtgagacaggtgctgcatggctgtcgtcagctcgtgttgtgaaatgttgggttaagtcccgcaacgagcgcaacccttatcctttgttgccagcgattaggtcgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaacc

SEQ ID NO: 306 - DNA, 730 bp, Pantoea agglomerans
aacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaacc

SEQ ID NO: 307 - DNA, 730 bp, Neisseria meningitidis
aacaggattagataccctggtagtccacgctgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcatatacaaagagaagcgacctcgcgagagcaagcggacctcataaagtacgtcgtagtccggattggagtctgcaactcgactccatgaagtcggaatcgctagtaatcgtagatcagaatgctacggtgaatacgttcccgggccttgtacacaccgcccgtcacaccatgggagtgggttacaaaagaagtaggtagcttaaccttcgggagggcgcttaccactttgtgattcatgactggggtgaagtcgtaacaaggtaacc

SEQ ID NO: 308 - DNA, 730 bp, Pseudomonas protegens
aacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaacc

SEQ ID NO: 309 - DNA, 730 bp, Dyella ginsengisoli
aacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggctcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcagctcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaacc

SEQ ID NO: 310 - DNA, 732 bp, Pseudomonas putida
aacaggattagataccctggtagtccacgccgtaaacgatgataactagctgtcagggcacatggtgttttggtggcgcagctaacgcgttaagttatccgcctggggagtacggtcgcaagattaaaactcaaaggaattgacgggggcctgcacaagcggtggagcatgtggtttaattcgaagcaacgcgcagaaccttaccaacgtttgacatccctatcgcggatcgtggagacactttccttcagttcggctggataggtgacaggtgctgcatggctgtcgtcagctcgtgtcgtgagatgttgggttaagtcccgcaacgagcgcaaccctcgcctttagttgccagcatttagtcgggtactctaaaggaaccgccggtgataagccggaggaaggtggggatgacgtcaagtcctcatggcccttacgcgttgggctacacacgtgctacaatggcgactacagtgggcagccacctcgcgagagggagctaatctccaaaagtcgtctcagttcggatcgttctctgcaactcgagagcgtgaaggcggaatcgctagtaatcgcggatcagcatgccgcggtgaatacgttcccaggccttgtacacaccgcccgtcacaccatgggagttggattcactcgaaggcgttgagctaaccgtaaggaggcaggcgaccacggtgggtttagcgactggggtgaagtcgtaacaaggtaacc

SEQ ID NO: 311 - DNA, 730 bp, Bacillus psychrosaccharolyticus
aacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccctatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaacc

SEQ ID NO: 312 - DNA, 730 bp, Deinococcus ficus
aacaggattagataccctggtagtccacgccgtaaacgatgtcgacttggaggttgtgcccttgaggcgtggcttccggggctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccggagaacttagcagagatgctttggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaacc

SEQ ID NO: 313 - DNA, 732 bp, Achromobacter spanius
aacaggattagataccctggtagtccacgccgtaaacgatgagtgctaagtgtcgggggtgaccaaccctcggtgctgtcgctaacgcaataagcgctccgcctggggagtacggccgcaaggctgaaactcaaaggaattgacggggacccgcacaagcggtggagcatgtggtttaattcgaagcaacgcgaagaaccttaccaaggcttgacatccccctgaccgatttagagatagatctttcccttcggggacaggggtgacaggtggtgcatggttgtcgtcagctcgtgtcgtgagatgttgggttaagtcccgcaacgagcgcaacccttatctttagttgccagcattcagttgggcactctagagagactgccggtgacaaaccggaggaaggtggggatgacgtcaaatcatcatgccccttatgtcttgggctacacacgtgctacaatggttggtacaaagggctgcaagccagcgatggtaagccaatcccataaagccaatctcagttcggattgtaggctgcaactcgcctacatgaagtcggaatcgctagtaatcgcagatcagcatgctgcggtgaatacgttcccgggtcttgtacacaccgcccgtcacaccacgagagtttacaacacccgaagtcggtgaggtaaccgcaaaggagccagccgcctaagtgggggtagatgattggggtgaagtcgtaacaaggtaacc

SEQ ID NO: 314 - DNA, 732 bp, Tatumella morbirosei
aacaggattagataccctggtagtccacgccgtaagcgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaggtcttgacatccctctgaccggtctagagataggccttcccttcggggcagaggagacaggtggtgcatggttgtcgtcagctcgtgtcgtgagatgttgggttaagtcccgcaacgagcgcaacccctatttttagttgccagcactttgggtgggcactctaaagagactgccggtgacaaaccggaggaaggtggggatgacgtcaaatcatcatgccccttatgacctgggctacacacgtactacaatggccagtacaacgggaagcgaagtcgcgagacggagccaatcctatcaaagctggtctcagttcggattgcaggctgcaactcgcctgcatgaagtcggaattgctagtaatcgcggatcagcatgccgcggtgaatacgttcccgggccttgtacacaccgcccgtcacaccatgggagtgggttgcaaaagaagtagatagcttaaccttcgggagggcgtttaccactttgtgattcatgactggggtgaagtcgtaacaaggtaacc

SEQ ID NO: 315 - DNA, 733 bp, Leclercia adecarboxylata
aacaggattagataccctggtagtccacgccgtaaacgatgaatgccagccgttggggtgcatgcacctcagtggcgcagctaacgctttaagcattccgcctggggagtacggccgcaagattaaaactcaaaggaattgacgggggcccgcacaagcggtggagcatgtggtttaattcgaagcaacgcgcagaaccttaccagcttttgacatgtccggtttgatcgacagagatgtctttcttcagttcggctggccggaacacaggtgctgcatggctgtcgtcagctcgtgtcgtgagatgttgggttaagtcccgcaacgagcgcaaccctcgcccctagttgccatcattcagttgggaactctagggggactgccggtgataagccgcgaggaaggtggggatgacgtcaagtcctcatggcccttacaggctgggctacacacgtgctacaatggcggtgacaatgggcagcgaaagggcgacctcgagctaatcccaaaaagccgtctcagttcagattgtactctgcaactcgagtacatgaaggtggaatcgctagtaatcgtggatcagcatgccacggtgaatacgttcccgggccttgtacacaccgcccgtcacaccatgggagttgggtttacccgaaggcgtcgcgctaaccgcaaggaggcaggcgaccacggtgggctcattcgactggggtgaagtcgtaacaaggtaacc

SEQ ID NO: 316 - DNA, 731 bp, Enterobacter dissolvens
aacaggattagataccctggtagtccacgccgtaaacgatgtctactagctgttcgtggtcttgtactgtgagtagcgcagctaacgcactaagtagaccgcctggggagtacggtcgcaagattaaaactcaaatgaattgacgggggcccgcacaagcggtggagcatgtggtttagttcgacgcaacgcgaagaaccttacctactcttgacatctacggaagactgcagagatgcggttgtgccttcgggaaccgtaagacaggtgctgcatggctgtcgtcagctcgtgttgtgaaatgttgggttaagtcccgcaacgagcgcaacccctatccttagttgccagcacgtaatggtgggaactctagggagactgccggtgataaaccggaggaaggtggggacgacgtcaagtcatcatggcccttacgagtagggctacacacgtgctacaatggtacgtacagagggaggcaagctggcgacagtgagcggatctcttaaagcgtatcgtagtccggatcgcagtctgcaactcgactgcgtgaagtcggaatcgctagtaatcgcaaatcagaatgttgcggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaacc

SEQ ID NO: 317 - DNA, 730 bp, Enterobacter cancerogenus
aacaggattagataccctggtagtccatgccgtaaacgatgtctactagccgttggggcctttgaggctttagtggcgcagctaacgcgataggtagaccgcctggggagtacggtcgcaagactaaaactcaaatgaattgacgggggcccgcacaagcggtggagcatgtggtttaattcgatgcaacgcgaagaaccttacctggccttgacatactagaaactttccagagatggattggtgccttcgggaatctagatacaggtgctgcatggctgtcgtcagctcgtgtcgtgagatgttgggttaagtcccgcaacgagcgcaacccttttcctcacttgccagcatttcggatgggaactttaaggatactgccagtgacaaactggaggaaggcggggacgacgtcaagtcatcatggcccttacggccagggctacacacgtgctacaatggtcggtacaaagggttgctacacagcgatgtgatgctaatctcaaaaagccgatcgtagtccggattggagtctgcaactcgactccatgaagtcggaatcgctagtaatcgcggatcagaatgccgcggtgaatacgttcccgggccttgtacacaccgcccgtcacaccatgggagtttgttgcaccaggagtagctagcctaactgcaaagagggcggttaccacggtgtggccgatgactggggtgaagtcgtaacaaggtaacc

SEQ ID NO: 318 - DNA, 731 bp, Serratia marcescens
aacaggattagataccctggtagtccatgccgtaaacgatgtctactagccgttggggcctttgaggctttagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggtcttgacatagtaagaactttccagagatggattggtgccttcgggaacttacatacaggtgctgcatggctgtcgtcagctcgtgtcgtgagatgttgggttaagtcccgcaacgagcgcaacccttttcctcatttgccagcgggttaagccgggaactttaaggatactgccagtgacaaactggaggaaggcggggacgacgtcaagtcatcatggcccttacgaccagggctacacacgtgctacaatggtcggtacaaagggttgctgcctagcgataggatgctaatctcaaaaagccgatcgtagtccggattggagtctgcaactcgactccatgaagtcggaatcgctagtaatcgcggatcagaatgccgcggtgaatacgttcccgggccttgtacacaccgcccgtcacaccatgggaatttgttgcaccagaagtaggtagtctaaccgcaaggaggacgcttaccacggtgtggccgatgactggggtgaagtcgtaacaaggtaacc

SEQ ID NO: 319 - DNA, 731 bp, Erwinia cypripedi
aacaggattagataccctggtagtccatgccgtaaacgatgtctactagccgttggggcctttgaggctttagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggtcttgacatagtaagaactttccagagatggattggtgccttcgggaacttacatacaggtgctgcatggctgtcgtcagctcgtgtcgtgagatgttgggttaagtcccgcaacgagcgcaacccttttccttatttgccagcgggttaagccgggaactttaaggatactgccagtgacaaactggaggaaggcggggacgacgtcaagtcatcatggcccttacggccagggctacacacgtgctacaatggtcggtacaaagggttgctacctcgcgagaggatgctaatctcaaaaagccgatcgtagtccggattggagtctgcaactcgactccatgaagtcggaatcgctagtaatcgcggatcagaatgccgcggtgaatacgttcccgggacttgtacacaccgcccgtcacaccatgggagtttgttgcaccagaagtaggtagtctaaccttaggggggacgcttaccacggcgtggcagatgactggggtgaagtcgtaacaaggtaacc

SEQ ID NO: 320 - DNA, 731 bp, Erwinia aphidicola
aacaggattagataccctggtagtccatgccgtaaacgatgtctactagccgttggggcctttgaggctttagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggccttgacatactaagaactttccagagatggattggtgccttcgggaacttagatacaggtgctgcatggctgtcgtcagctcgtgtcgtgagatgttgggttaagtcccgcaacgagcgcaacccttttccttatttgccatcgggtaatgccgggaactttaaggatactgccagtgacaaactggaggaaggcggggacgacgtcaagtcatcatggcccttacggccagggctacacacgtgctacaatggtcggtacaaagggttgctacctcgcgagaggatgctaatctcaaaaagccgatcgtagtccggatcgcagtctgcaactcgactgcgtgaagtcggaatcgctagtaatcgcggatcagaatgccgcggtgaatacgttcccgggccttgtacacaccgcccgtcacaccatgggagtttgttgcaccagaagtaggtagtctaaccgcaaggaggacgcgtaccacggtgtggccgatgactggggtgaagtcgtaacaaggtaacc

SEQ ID NO: 321 - DNA, 725 bp, Sphingomonas yanoikuyae
aacaggattagataccctggtagtccacgccctaaacgatgtcaactggttgttgggagggtttcttctcagtaacgtagctaacgcgtaaagttgaccgcctggggagtacggccgcaaggttgaaactcaaaggaattgacggggacccgcacaagcggtggatgatgtggtttaattcgatgcaacgcgaaaaaccttacctacccttgacatgccaggaatcttgcagagatgtgagagtgctcgaaagagaacctggacacaggtgctgcatggccgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaggtcatcatggcccttatgggtagggctacacacgtcatacaatggccgggacagagggctgccaacccgcgagggggagctaatcccagaaacccggtcgtagtccggatcgcagtctgcaactcgactgcgtgaagtcggaatcgctagtaatcgcggatcagcttgccgcggtgaatacgttcccgggtcttgtacacaccgcccgtcacaccatgggagcgggttctgccagaagtagttagcctaaccgcaaggagggcgattaccacggcagggttcgtgactggggtgaagtcgtaacaaggtaacc

SEQ ID NO: 322 - DNA, 725 bp, Pantoea anthophila
aacaggattagataccctggtagtccacgccctaaacgatgtcaactggttgttgggagggtttcttctcagtaacgtagctaacgcgtgaagttgaccgcctggggagtacggccgcaaggttgaaactcaaaggaattgacggggacccgcacaagcggtggatgatgtggtttaattcgatgcaacgcgaaaaaccttacctacccttgacatgccaggaatcttgcagagatgtgagagtgctcgaaagagaacctggacacaggtgctgcatggccgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaggtcatcatggcccttatgggtagggctacacacgtcatacaatggccgggacagagggctgccaacccgcgagggggagctaatcccagaaacccggtcgtagtccggatcgcagtctgcaactcgactgcgtgaagtcggaatcgccagtaatcgcggatcagcttgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtaacc

SEQ ID NO: 323 - DNA, 725 bp, Pantoea dispersa
aacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcccgctgagaggtgggagtgctcgaaagagaaccggcgcacaggtgctgcatggctgtcgtcagctcgtgtcgtgagatgttgggttaagtcccgcaacgagcgcaacccttgtccttagttgctacgcaagagcactctaaggagactgccggtgacaaaccggaggaaggtggggatgacgtcaagtcctcatggcccttatgggtagggcttcacacgtcatacaatggtcggaacagagggttgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacgcaccgcccgtcacaccatgggagtgggttttaccagaagtggctagtctaaccgcaaggaggacggtcaccacggtaggattcatgactggggtgaagtcgtaacaaggtaacc

SEQ ID NO: 324 - DNA, 734 bp, Oxalophagus oxalicus
aacaggattagataccctggtagtccacgccgtaaacgatgataactagctgtccgggttcatagaacttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatcctgatcgcggattagagagatcttttccttcagttcggctggatcagtgacaggtgctgcatggctgtcgtcagctcgtgtcgtgagatgttgggttaagtcccgcaacgagcgcaaccctcatccctagttgccatcattcagttgggcactctaaggaaactgccggtgataagccggaggaaggtggggatgacgtcaagtcctcatggcccttacgcgctgggctacacacgtgctacaatggcggtgacagtgggcagcaaccctgcgaggggtagctaatctccaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttggtttcacccgaaggcagtgctctaacccgcaagggaggaagctgaccacggtgggatcagcgactggggtgaagtcgtaacaaggtaacc

SEQ ID NO: 325 - DNA, 729 bp, Paenibacillus nanensis
aacaggattagataccctggtagtccacgccctaaacgatgtctactagttgtcgggttttaattaacttggtaacgcagctaacgcgtgaagtagaccgcctggggagtacggtcgcaagattaaaactcaaaggaattgacggggacccgcacaagcggtggatgatgtggattaattcgatgcaacgcgaaaaaccttacctacccttgacatgtacggaagccacgagaggtcgaggtgtgctcgaaagagaaccgtaacacaggtgctgcatggctgtcgtcagctcgtgtcgtgagatgttgggttaagtcccgcaacgagcgcaacccttgtcattagttgctacatttagttgagcactctaatgagactgccggtgacaaaccggaggaaggtggggatgacgtcaagtcctcatggcccttatgggtagggcttcacacgtcatacaatggtacatacagagggccgccaacccgcgagggggagctaatcccagaaagtgtatcgtagtccggatcgcagtctgcaactcgactgcgtgaagttggaatcgctagtaatcgcggatcagcatgtcgcggtgaatacgttcccgggtcttgtacacaccgcccgtcacaccatgggagcgggttttaccagaagtaggtagcttaaccgcaaggagggcgcttaccacggtaggattcgtgactggggtgaagtcgtaacaaggtaacc

SEQ ID NO: 326 - DNA, 726 bp, Bosea vestrisii
aacaggattagataccctgcgtagtccacgccctaaacgatgtcaactagttgtcgggtcttaattgacttggtaacgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggcaggaatcctggagagatccgggagtgctcgaaagagaacctgcacacaggtgctgcatggctgtcgtcagctcgtgccgtgagacgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtacatacagagggccgccaacccgcgagggggagctaatcccagaaagtgtatcgtagtccggattggagtctgcaactcgactccatgaagttggaatcgctagtaatcgcggatcagcatgtcgcggtgaatacgttcccgggtcttgtacacaccgcccgtcacaccatgggagcgggttttaccagaagtaggtagcttaaccgcaaggagggcgcttaccacggtaggattcgtgactggggtgaagtcgtaacaaggtaacc

SEQ ID NO: 327 - DNA, 731 bp, Rheinheimera soli
aacaggattagataccctggtagtccacgccgtaaacgatgtcaactagccgttggaagccttgagcttttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttctagagatagattggtgccttcgggaacattgagacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccataaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtaacc

SEQ ID NO: 328 - DNA, 730 bp, Acinetobacter baumannii
aacaggattagataccctggtagtccacgccgtaaacgatggaagctagccgttggtaagcatgcttatcagtggcgcagctaacgcattaagcttcccgcctggggagtacggtcgcaagattaaaactcaaaggaattgacgggggcccgcacaagcggtggagcatgtggttcaattcgacgcaacgcgaagaaccttaccagcccttgacatgtccaggaccggtcgcagagacgcgaccttctcttcggagcctggaacacaggtgctgcatggctgtcgtcagctcgtgtcgtgagatgttgggttaagtcccgcaacgagcgcaaccctcgtccttagttgccatcattaagttgggcactctaaggagactgccggtgataagccgcgaggaaggtggggatgacgtcaagtcctcatggcccttacgggctgggctacacacgtgctacaatggcagtgacaatgggcagcgaacccgcaagggggagctaatctctaaaaaccgtctcagttcggattgcactctgcaactcgagtgcatgaagttggaatcgctagtaatcgtggatcagcatgccacggtgaatacgttcccgggccttgtacacaccgcccgtcacaccatgggagttggttttaccttaagacggtgcgctaaccgcaaggaggcagccggccacggtaaggtcagcgactggggtgaagtcgtaacaaggtaacc

SEQ ID NO: 329 - DNA, 733 bp, Acinetobacter johnsonii
aacaggattagataccctggtagtccacgccctaaacgatgcgaactggatgttgggtgcaatttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggccttgacatgtcgagaactttccagagatggattggtgccttcgggaactcgaacacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacggccagggctacacacgtactacaatggtagggacagagggctgcaagccggcgacggtaagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgcttgccacggtgtggccgatgactggggtgaagtcgtaacaaggtaacc

SEQ ID NO: 330 - DNA, 730 bp, Acinetobacter beijerinckii
aacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaagttttcagagatgagaatgtgccttcgggaaccgtgagacaggtgctgcatggctgtcgtcagctcgtgttgtgaaatgttgggttaagtcccgcaacgagcgcaacccctatcctttgttgccagcggtccggccgggaactcaaaggagactgccagtgataaactggaggaaggtggggatgacgtcaagtcatcatggcccttacgaccagggctacacacgtgctacaatggcgcatacagagagaagcgacctcgcgagagcaagcggacctcataaagtgtgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaacc

SEQ ID NO: 331 - DNA, 730 bp, Acinetobacter schindleri
aacaggattagataccctggtagtccacgccgtaaacgatggacacttggtgttggaggtattgaccccttcagtgccgaagctaacgcgttaagtgtcccgcctggggagtacggccgcaaggttaaaactcacagaaattgacgggggcccgcacaagcggtggagcatgtggtttaattcgatgcaacgcgcagaaccttacctagatttgacatgtaatggaagactggcagaaatgtcgtcgcccgcaagggccgttacacaggtgctgcatggctgtcgtcagctcgtgtcgtgagatgttgggttaagtcccgcaacgagcgcaacccctatgtttagttgccagcattcagttgggcactctagacagactgccggtgttaaaccggaggaaggtggggatgacgtcaagtcctcatggcctttatatctagggctacacacgtgctacaatggtcggtacagagggaagcaagagtgcgaactggagctaatcccaaaaaaccgatctaagttcggatagaagtctgcaactcgacttcttgaagctggaatcgctagtaatcgtggatcagaacgccacggtgaatacgttcccgggccttgtacacaccgcccgtcacaccatgaaagttgtgcctaccagaagtcactgcgttaaccgcaaggagacaggtgcccaaggtaggaacgatgattggggtgaagtcgtaacaaggtaacc

SEQ ID NO: 332 - DNA, 730 bp, Roseateles depolymerans
aacaggattagataccctggtagtccacgccgtaaacgatgtcgacttggaggttgtgcccttgaggcgtggcttccggagctaacgcgttaagtcgaccgcctggggagtacggccgcaaggttcaaactcaaatgaattgacgggggcccgcacaagcggtggagcatgtggcttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgcacacaccgcccgtcacaccatgggagtgggttgcaaaagaagtaggtagcttaaccttcgggagggcgcttaccactttgtgattcatgactggggtgaagtcgtaacaaggtaacc

SEQ ID NO: 333 - DNA, 729 bp, Roseateles terrae
aacaggattagataccctggtagtccacgccgtaaacaatgtctactagccgttggggtccttgagactttagtggcgcagttaacgcgataagtagaccgcctggggagtacggccgcaaggttaaaactcaaatgaattgacgggggcccgcacaagcggtggagcatgtggtttaattcgatgcaacgcgaagaaccttacctggtcttgacatagtgagaatcctgcagagatgcgggagtgccttcgggaattcacatacaggtgctgcatggctgtcgtcagctcgtgtcgtgagatgttgggttaagtcccgcaacgagcgcaacccttttccttatttgccagcgggttaagccgggaactttaaggatactgccagtgacaaactggaggaaggcggggacgacgtcaagtcatcatggcccttacgaccagggctacacacgtgctacaatggtaggtacagagggttgctacacagcgatgtgatgctaatcccaaaaagcctatcgtagtccggattggagtctgcaactcgactccatgaagtcggaatcgctagtaatcgcagatcagaatgctgcggtgaatacgttcccgggccttgtacacaccgcccgtcacaccatgggagtctattgcaccagaagtaggtagcctaacgcaagagggcgcttaccacggtgtggtcgatgactggggtgaagtcgtaacaaggtaacc

SEQ ID NO: 334 - DNA, 730 bp, Burkholderia diffusa
aacaggattagataccctggtagtccacgccctaaacgatgtcaactggttgttgggtcttcactgactcagtaacgaagctaacgcgtgaagttgaccgcctggggagtacggccgcaaggttgaaactcaaaggaattgacggggacccgcacaagcggtggatgatgtggtttaattcgatgcaacgcgaaaaaccttacccacctttgacatgtacggaattcgccagagatggcttagtgctcgaaagagagccgtaacacaggtgctgcatggctgtcgtcagctcgtgtcgtgagatgttgggttaagtcccgcaacgagcgcaacccttgtcattagttgctacattcagttgggcactctaatgagactgccggtgacataccggaggaaggtggggatgacgtcaagtcctcatggcccttataggtggggctacacacgtcatacaatggctggtacaaagggttgccaacccgcgagggggagctaatcccataaaaccagtcgtagtccggatcgcagtctgcaactcgactgcgtgaagtcggaatcgctagtaatcgtggatcagaatgtcacggtgaatacgttcccgggtcttgtacacaccgcccgtcacaccatgggagcgggttctgccagaagtagttagcttaaccgcaaggagggcgattaccacggcagggtttcgtgactggggtgaagtcgtaacaaggtaacc

SEQ ID NO: 335 - DNA, 734 bp, Sphingopyxis panaciterrae
aacaggattagataccctggtagtccacgccgtaaacgatgagtgctagacgtcgggaagcttgcttttcggtgtcgcagctaacgcattaagcactccgcctggggagtacggccgcaaggttaaaactcaaaggaattgacgggggcccgcacaagcggtggagcatgtggtttaattcgatgcaacgcgaagaaccttaccagctcttgacatattgggttatggattcgagagatcgattccttcagttcggctgggcccagtacaggtgctgcatggctgtcgtcagctcgtgtcgtgagatgttgggttaagtcccgcaacgagcgcaaccctcatcttcagttgccatcaggtcaagctgggcactctgaagaaactgccggtgacaagccggaggaaggtggggatgacgtcaagtcctcatggcccttacgggctgggctacacacgtgctacaatgacggtgacagtgggatgcgatggcgcgagccggagcgaatctccaaaagccgtctcagttcggattgcactctgcaactcgggtgcatgaagttggaatcgctagtaatcgtggatcagcatgccacggtgaatacgttcccgggccttgtacacaccgcccgtcacaccatgggagttggttttaccttaagacggtgcgctaaccgcaaggaggcagccggccacggtaaggtcagcgactggggtgaagtcgtaacaaggtaacc

SEQ ID NO: 336 - DNA, 732 bp, Massilia aerolata
aacaggattagataccctggtagtccacgccgtaaacgatgataactagctgtcagggcacatggtgttttggtggcgcagctaacgcattaagttatccgcctggggagtacggtcgcaagattaaaactcaaaggaattgacgggggcctgcacaagcggtggagcatgtggtttaattcgaagcaacgcgcagaaccttaccaacgtttgacatccctatcgcggatcgtggagacactttccttcagttcggctggataggtgacaggtgctgcatggctgtcgtcagctcgtgtcgtgagatgttgggttaagtcccgcaacgagcgcaaccctcgcctttagttgccagcatttagttgggtactctaaaggaaccgccggtgataagccggaggaaggtggggatgacgtcaagtcctcatggcccttacgcgttgggctacacacgtgctacaatggcgactacagtgggcagccacctcgcgagagggagctaatctccaaaagtcgtctcagttcggatcgttctctgcaactcgagagcgtgaaggcggaatcgctagtaatcgcggatcagcatgccgcggtgaatacgttcccaggccttgtacacaccgcccgtcacaccatgggagttggattcactcgaaggcgttgagctaaccgtaaggaggcaggcgaccacagtgggtttagcgactggggtgaagtcgtaacaaggtaacc

SEQ ID NO: 337 - DNA, 729 bp, Massilia albidiflava
aacaggattagataccctggtagtccgcgccgtaaactatgagagctagccgttggagggtttacccttcagtggcgcagctaacgcattaagctctccgcctggggagtacggtcgcaagattaaaactcaaaggaattgacgggggcccgcacaagcggtggagcatgtggtttaattcgaagcaacgcgaagaaccttaccagcccttgacatggcaagacggttcccagagatgggttccttcacttcggtgacttgcacacaggtgctgcatggctgtcgtcagctcgtgtcgtgagatgttgggttaagtcccgcaacgagcgcaaccctcgtccttagttgccatcatttagttgggcactctaaggagactgccggtgataagccggaggaaggtggggatgacgtcaagtcatcatggcccttatgggctgggctacacacgtgctacaatggcggtgacagagggcagctacacggcgacgtgatgctaatcccaaaaaaccgtctcagttcggattgcactctgcaactcgggtgcatgaagttggaatcgctagtaatcgcagatcagcatgctgcggtgaatacgttcccgggccttgtacacaccgcccgtcacaccatgggagttggttctacccgaagccggtgcgctaaccgcaaggaagcagccgaccacggtagggtcagcgactggggtgaagtcgtaacaaggtaacc

SEQ ID NO: 338 - DNA, 730 bp, Pseudomonas poae
aacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacagaactttccagagatggattggtgccttcgggaactgtgagacaggtgctgcatggctgtcgtcagctcgtgttgtgaaatgttgggttaagtcccgcaacgagcgcaacccttatcttttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatatgtccccgggccttgtacacaccgcccgtcacaccatgggagtgggttgcaaaagaagtaggtagcttaaccttcgggagggcgcttaccactttgtgattcatgactggggtgaagtcgtaacaaggtaacc

SEQ ID NO: 339 - DNA, 732 bp, Ancylobacter rudongensis
aacaggattagataccctggtagtccacgccgtaaacgatgaagactagctgtcagggcgcttagcgctttggtggcgcagctaacgcattaagtcttccgcctggggagtacggccgcaaggttaaaactcaaaggaattgacgggggcctgcacaagcggtggagcatgtggtttaattcgaagcaacgcgcagaaccttaccagcgtttgacatcccgatcgcggagagtggagacacactccttcagttaggctggatcggtgacaggtgctgcatggctgtcgtcagctcgtgtcgtgagatgttgggttaagtcccgcaacgagcgcaaccctcgcctttagttgccatcatttagttgggcactctaaaggaactgccggtgataagccggaggaaggtggggatgacgtcaagtcctcatggcccttacgcgctgggctacacacgtgctacaatggcggtgacagtgggctgcaatcccgcaagggggagcaaatctccaaaagccgtctcagttcggattgtcctctgcaactcgagggcatgaaggcggaatcgctagtaatcgcggatcagcatgccgcggtgaatacgttcccaggccttgtacacaccgcccgtcacaccatgggagttggtttcacctgaaggcagtgcgctaaccgcaaggaggcagctgaccacggtgggatcagcgactggggtgaagtcgtaacaaggtaacc

SEQ ID NO: 340 - DNA, 735 bp, Stenotrophomonas pavanii
aacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaggtcttgacatccccctgatcggtctagggatagatctttccttcgggacaggggagacaggtggtgcatggttgtcgtcagctcgtgtcgtgagatgttgggttaagtcccgcaacgagcgcaacccttatgcttagttgccagcaggtcaagctgggcactctaagcagactgccggtgacaaaccggaggaaggtggggatgacgtcaaatcatcatgccccttatgacctgggctacacacgtactacaatggccggtacaacgggaagcgaaagagcgatctggagcgaatcctagaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaacccgcaagggagccagccgccgaaggtggggtagatgattggggtgaagtcgtaacaaggtaacc

SEQ ID NO: 341 - DNA, 731 bp, Shigella flexneri
aacaggattagataccctggtagtccacgccgtaaacgatgagtgctaggtgttaggggtttcgatacccttggtgccgaagttaacacattaagcactccgcctggggagtacggtcgcaagactgaaactcaaaggaattgacggggacccgcacaagcagtggagtatgtggtttaattcgaagcaacgcgaagaaccttgccaggtcttgacatccctctgaccggtacagagatgtatctttccttcgggacagaggagacaggtggtgcatggttgtcgtcagctcgtgtcgtgagatgttgggttaagtcccgcaacgagcgcaacccttgatcttagttgccagcatttcggatgggcactctaaggtgactgccggtgacaaaccggaggaaggtggggatgacgtcaaatcatcatgccccttatgacctgggctacacacgtactacaatggccggtacaacgggctgtgaagccgcgaggtggaacgaatcctaaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacgcccgaagtcggtggggtaaccgcaaggagccagccgccgaaggtgggatagatgattggggtgaagtcgtaacaaggtaacc

SEQ ID NO: 342 - DNA, 731 bp, Bdellovibrio bacteriovorus
aacaggattagataccctggtagtccacgccgtaaacgatgagtgctaggtgttagggggtttccgccccttagtgctgaagttaacgcattaagcactccgcctggggagtacggccgcaaggctgaaactcaaaagaattgacgggggcccgcacaagcggtggagcatgtggtttaattcgacgcaacgcgaagaaccttaccaggtcttgacatcctctgacaactccagagatggagctttcccttcggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggaacagagggaagcgaaaccgcgaggtcaagcaaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagttggtaacacccgaagtcggtgaggtaacctttttggagccagccgccgaaggtgggactgatgattggggtgaagtcgtaacaaggtaacc

SEQ ID NO: 343 - DNA, 730 bp, Enterobacter cancerogenus
aacaggattagataccctggtagtccatgccgtaaacggtgggcgctaggtgtgagggtcttttcacgactttcgtgccgtagcaaacgcattaagcgccccgcctggggagtacggccgcaaggctaaaactcaaaggaattgacgggggcccgcacaagcggcggagcatgtggattaattcgatgcaacgcgaagaaccttacctgggcttgacatacactggatcgctgcagagatgtagtttccctttgtggctggtgtacaagtggtgcatggttgtcgtcagctcgtgtcgtgagacgttgggttaagtcccgcaacgagcgcaacccttgtcttatgttgccagcatttggttggggactcatgagagactgccggggtcaactcggaggaaggtggggatgacgtcaaatcatcatgccccttatgtccagggcttcacacatgctacaatggtcggtacaacgcgcagcgacactgtgaggtggagcgaatcgctgaaagccggccttagttcggattggggtctgcaactcgaccccatgaagtcggagtcgctagtaatcgcagatcagcaatgctgcggtgaatacgttcccgggccttgtacacaccgcccgtcacgtcatgaaagttggtaacacccgaagccggtggcccaaacttgttagggagccgtcgaaggtgggatcggcgattgggacgaagtcgtaacaaggtaacc

SEQ ID NO: 344 - DNA, 735 bp, Enhydrobacter aerosaccus
aacaggattagataccctggtagtccatgccgtaaacggtgggtactaggtgtggggctccttccacggactccgtgccgtagctaacgcattaagtaccccgcctggggagtacggccgcaaggctaaaactcaaagaaattgacgggggcccgcacaagcggcggagcatgtggattaattcgatgcaacgcgaagaaccttacctgggtttgacatacaccagaaagcggcagagatgtcgccccccttgtggttggtgtacaggtggtgcatggctgtcgtcagctcgtgtcgtgagatgttgggttaagtcccgcaacgagcgcaacccttatcttatgttgccagcgcgtaatggcggggactcgtgagagactgccggggtcaactcggaggaaggtggggacgacgtcaagtcatcatgccccttatgtccagggcttcacacatgctacaatggccggtacagagggctgcgataccgtgaggtggagcgaatcccttaaagccggtctcagttcggatcggggtctgcaactcgaccccgtgaagttggagtcgctagtaatcgcagatcagcaacgctgcggtgaatacgttcccgggccttgtacacaccgcccgtcacgtcatgaaagtcggtaacacccgaagccggtggcctaaccccttgtgggagggagccgtcgaaggtgggatcggcgattgggacgaagtcgtaacaaggtaacc

SEQ ID NO: 345 - DNA, 733 bp, Variovorax boronicumulans
aacaggattagataccctggtagtccacgccgtaaacggtgggtgctaggtgtggggggcttccacgccctctgtgccgcagctaacgcattaagcaccccgcctggggagtacggccgcaaggctaaaactcaaaggaattgacgggggcccgcacaagcggcggagcatgtggattaattcgatgcaacgcgaagaaccttacctgggcttgacatggactagaaagctctagagatagagcctcccttgtggctggttcacaggtggtgcatggctgtcgtcagctcgtgtcgtgagatgttgggttaagtcccgcaacgagcgcaaccctcgttccatgttgccagcacgtaatggtggggactcatgggagactgccggggtcaactcggaggaaggtggggatgacgtcaagtcatcatgccccttatgtccagggcttcacacatgctacaatggccggtacaaagggctgctaagccgtgaggtggagcgaatcccataaagccggtctcagttcggatcggggtctgcaactcgaccccgtgaagtcggagtcgctagtaatcgcagatcagcaacgctgcggtgaatacgttcccgggccttgtacacaccgcccgtcacgtcacgaaagtcggtaacacccgaagcccgtggctcaacccgcaagggggagagcggtcgaaggtgggactggcgattgggacgaagtcgtaacaaggtaacc

SEQ ID NO: 346 - DNA, 714 bp, Oceanibaculum pacificum
aacaggattagataccctggtagtccacgccgtaaacgatggatactagctgttgggagcaatctcagtggctaagcgaaagtgataagtatcccacctggggagtacgaacgcaagtttgaaactcaaaggaattgacgggggcccgcacaagcggtggagcatgtggtttaattcgatgatacgcgaggaaccttaccaaggcttaaatgtagattgacaggactggaaacagttttttcttcggacaatttacaaggtgctgcatggttgtcgtcagctcgtgccgtgaggtgtcaggttaagtcctataacgagcgcaacccctgttgttagttgccagcgagtcaagtcgggaactctaacaagactgccagtgcaaactgtgaggaaggtggggatgacgtcaaatcatcacggcccttacgccttgggctacacacgtgctacaatggccggtacagagagcagccattgggtgaccaggagcgaatctacaaaaccggtcacagttcggatcggagtctgcaactcgactccgtgaagctggaatcgctagtaatcggatatcagccatgatccggtgaatacgttcccgggccttgtacacaccgcccgccaagccatggaagctgggggtgcctgaagtcggtgaccgcaaggagctgcctagggtaaaactggtaactagggctaagtcgtaacaaggtaacc

SEQ ID NO: 347 - DNA, 714 bp, Sphingomonas yanoikuyae
aacaggattagataccctggtagtccacgccgtaaacgatggatactagctgttcggagcaatctgagtggctaagcgaaagtgataagtatcccacctggggagtacgttcgcaagaatgaaactcaaaggaattgacgggggcccgcacaagcggtggagcatgtggtttaattcgatgatacgcgaggaaccttaccagggcttaaatgtagtctgacaggaccggaaacggttttttcttcggacagattacaaggtgctgcatggttgtcgtcagctcgtgccgtgaggtgccaggttaagtcctataacgagcgcaacccctgtcgttagttgccagcgagtcatgtcgggaactctaacgagactgccagtgcaaactgagaggaaggtggggatgacgtcaaatcatcacggcccttacgccctgggctacacacgtgctacaatgggcggtacagagagcagccactccgcgaggaggagcgaatctacaaaaccgttcacagttcggatcggagtctgcaactcgactccgtgaagctggaatcgctagtaatcggatatcagccatgatccggtgaatacgttcccgggccttgtacacaccgcccgtcaagccatggaagctgggggtgcctgaagtcggtgaccgcaaggagctgcctagggtaaaaccggtaactggggctaagtcgtaacaaggtaacc

SEQ ID NO: 348 - DNA, 716 bp, Devosia riboflavina
aacaggattagataccctggtagtccacgccgtaaacgatgctaactcgtttttggggtttcggcttcagagactaagcgaaagtgataagttagccacctggggagtacgttcgcaagaatgaaactcaaaggaattgacgggggcccgcacaagcggtggattatgtggtttaattcgatgatacgcgaggaaccttaccaagacttaaatgggaaatgacagatttagaaatagatccttcttcggacatttttcaaggtgctgcatggttgtcgtcagctcgtgccgtgaggtgttaggttaagtcctgcaacgagcgcaacccctgtcactagttgctagcattaagttgaggactctagtgagactgcctacgcaagtagagaggaaggtggggatgacgtcaaatcatcacggcccttacgtcttgggccacacacgtaatacaatggccggtacagagggcagctacacagcgatgtgatgcaaatctcgaaagccggtctcagttcggattggagtccgcaactcgactctatgaagctggaatcgctagtaatcgcgcatcagccatggcgcggtgaatacgttcccgggccttgtacacaccgcccgtcaagccatggaagtctggggtacctgaagtcggtgaccgtaaaaggagctgcctagggtaaaacaggtaactagggctaagtcgtaacaaggtaacc

SEQ ID NO: 349 - DNA, 728 bp, Escherichia coli
aacaggattagataccctggtagtcctagccgtaaacggtgcacgtttgctgtaaaaggaatcgaccccttttgtggcgtagccaacgcgttaaacgcgccgcctgggaagtacggtcgcaagattaaaactcaaagaaattgacgggggcctgcacaagcgatggagtatgtggctcaattcgatgcaacgcgaagaaccttacctggccttgacatgcatatggtagaagggtgaaagcctgacgaggtagcaataccagtatgcacaggtgctgcatggctgtcgtcagctcgtgtcgtgagatgttgggttaagtcccgcaacgagcgcaacccctgtgtcctgttgccacccggtcgcaagactggagcactctggacagactgcctcgcttaaacgaggaggaaggtggggatgacgtcaagtcagtatggcccttacggccagggctgcacacgtactacaatggctggtacaaagggaagctagaccgtcaggtggagcaaatcccccaaaaccagccccagttcagattgtcgtctgcaactcgacggcatgaagctggaatcgctagtaatggcgcatcagctacggcgccgtgaatacgttcccaggccttgtacacaccgcccgtcacatcatgaaagccgtttgtacccgaagtcgttcctcgcgaacgccgaaggtatgaatggtgattgggatgaagtcgtaacaaggtaacc

SEQ ID NO: 350 - DNA, 733 bp, Sphingosinicella xenopeptidilytica
aacaggattagataccctggtagtccgagccgtaaacgatggatactaggtgttggaggtatcgacccctccagtgccgtagctaacgcgttaagtatcccgcctggggagtacggtcgcaagactgaaactcaaaggaattgacgggggcccgcacaagcggtggagcatgtggtttaattcgatgcaacgcgaagaaccttaccaaggcttgacatgtcgagaatcccttagaaataggggagtgccgcaaggagctcgaacacaggtggtgcatggctgtcgtcagctcgtgtcgtgagatgttgggttaagtcccgcaacgagcgcaaccctcgatgtcagttgccaacgggtaaagccgggcactctggcgtgactgccggtgacaaaccggaggaaggtggggatgacgtcaagtcatcatgccccttatgccttgggctacacacgtgctacaatggtcgggacagagggctgcaaagccgcgaggtggagccaatccctaaacccggtctcagttcagattgcaggctgcaactcgcctgcatgaaggcggaatcgctagtaaccgcagatcagcatgctgcggtgaatacgttcccgggccttgtacacaccgcccgtcacaccacgaaagtttgtcacgcccgaagccggtgagccaaccgcaaggaggcagccgtctaaggtggggcagatgattgggggtgaagtcggtaacaaggtaacc

SEQ ID NO: 351 - DNA, 730 bp, Paenibacillus daejeonensis
aacaggattagataccctggtagtccacgctgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctggtcttgacatccacagaactttccagagatggattggtgccttcgggaactgtgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgaccagggctacacacgtgctacaatggcatatacaaagagaagcgacctcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaacc

SEQ ID NO: 352 - DNA, 730 bp, Paenibacillus xylanilyticus
aacaggattagataccctggtagtccacgctgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctggtcttgacatccacagaacttagcagagatgctttggtgccttcgggaactgtgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgaccagggctacacacgtgctacaatggcatatacaaagagaagcgacctcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaacc

SEQ ID NO: 353 - DNA, 731 bp, Sediminibacillus halophilus
aacaggattagataccctggtagtccacgccgtaaacgatgtcaactagccgttggaatccttgagattttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatgcagagaactttccagagatggattggtgccttcgggaactctgacacaggtgctgcatggctgtcgtcagctcgtgtcgtgagatgttgggttaagtcccgtaacgagcgcaacccttgtccttcgttaccagcacgttatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatctcacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaacc

SEQ ID NO: 354 - DNA, 733 bp, Corynebacterium pseudogenitalium; identical to SEQ ID NO: 329

SEQ ID NO: 355 - DNA, 730 bp, Nocardia soli
aacaggattagataccctggtagtccacgccgtaaacgatgataactagctgtcggggctcttagagcttcggtggcgcagctaacgcattaagttatccgcctggggagtacggccgcaaggttaaaactcaaatgaattgacgggggcctgcacaagcggtggagcatgtggtttaattcgaagcaacgcgcagaaccttaccagcgtttgacatgtccggacgatttcgggagaccgatctcttcccttcggggactggaacacaggtgctgcatggctgtcgtcagctcgtgtcgtgagatgttgggttaagtcccgcaacgagcgcaaccctcgtccttagttgccatcatttagttgggcactctaaggaaaccgccggtgataagccggaggaaggtggggatgacgtcaagtcctcatggcccttacgcgctgggctacacacgtgctacaatggcggtgacagtgggcagcaatctcgcaagggtgagctaatctccaaaagccgtctcagttcggattgttctctgcaactcgagagcatgaaggcggaatcgctagtaatcgcggatcagcatgccgcggtggatacgttcccaggccttgtacacaccgcccgtcacaccatgggagttggattcacccgaaggcagtgcgctaaccgcaaggaggcagctgaccacggtgggttcagcgactggggtgaagtcgtaacaaggtaacc

SEQ ID NO: 356 - DNA, 732 bp, Lentzea flaviverrucosa
aacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagctcttgacattcggggtatgggcattggagacgatgtccttcagttaggctggccccagaacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagacagcgatgtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttttacccgaaggtagtgcgctaaccgcaaggaggcagctaaccacggtagggtcagcgactggggtgaagtcgtaacaaggtaacc

SEQ ID NO: 357 - DNA, 730 bp, Flavobacterium degerlachei
aacaggattagataccctggtagtccacgctgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatccttcgttgccagcggttcggccgggaactcgaaggagactgccagtgataaactggaggaaggtggggatgacgtcaagtcatcatggcccttacgagtagggctacacacgtgctacaatggcgtatacaaagagaagcgacctcgcgagagcaagcggacctcataaagtacgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaacc

SEQ ID NO: 358 - DNA, 730 bp, Flavobacterium aquatile
aacaggattagataccctggtagtccacgccgtaaacgatgataactagctgtcggggctcttagagcttcggtggcgcagctaacgcattaagttatccgcctggggagtacggccgcaaggttaaaactcaaatgaattgacgggggcctgcacaagcggtggagcatgtggtttaattcgaagcaacgcgcagaaccttaccagcgtttgacatgtccggacgatttcgggagaccgatctcttcccttcggggactggaacacaggtgctgcatggctgtcgtcagctcgtgtcgtgagatgttgggttaagtcccgcaacgagcgcaaccctcgtccttagttgccatcatttagttgggcactctaaggaaaccgccggtgataagccggaggaaggtggggatgacgtcaagtcctcatggcccttacgcgctgggctacacacgtgctacaatggcggtgacagtgggcagcaatctcgcaagggtgagctaatctccaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcagtgcgctaaccgcaaggaggcagctgaccacggtgggttcagcgactggggtgaagtcgtaacaaggtaacc

SEQ ID NO: 359 - DNA, 730 bp, Chryseobacterium hominis
aacaggattagataccctggtagtccacgccgtaaacgatgataactagctgtccggggacttggtccttgggtggcgcagctaacgcattaagttatccgcctggggagtacggccgcaaggttaaaactcaaatgaattgacgggggcctgcacaagcggtggagcatgtggtttaattcgaagcaacgcgcagaaccttaccagcgtttgacatggtaggacggcttccagagatggattccttcccttcggggacctacacacaggtgctgcatggctgtcgtcagctcgtgtcgtgagatgttgggttaagtcccgcaacgagcgcaaccctcgcctttagttaccatcatttagttgggtactctaaaggaaccgccggtgataagccggaggaaggtggggatgacgtcaagtcctcgtggcccttacgcgctgggctacacacgtgctacaatggcaactacagtgggcagcaatcccgcgagggtgagctaatctccaaaagttgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgtcgcgctaaccgcaaggaggcaggcgaccacggtgggtttagcgactggggtgaagtcgtaacaaggtaacc

SEQ ID NO: 360 - DNA, 730 bp, Unknown
  source: /note="Description of Unknown: Uncultured seed derived bacterium of the family Enterobacteriaceae"
aacaggattagataccctggtagtccacgctgtaaacgatgtcgatttggaggttgtgcccttgaggcgtggcttccggagctaacgcgttaagtcgaccgcctggggagtacggccacaaggttaaaactcaaatgaattgacgggggcccgcacaagcggtggagcatgtggtttaattcgatgcaacgcgaagaaccttacctggccttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaacc

SEQ ID NO: 361 - DNA, 733 bp, Unknown
  source: /note="Description of Unknown: Uncultured seed derived bacterium of the family Xanthomonadaceae"
aacaggattagataccctggtagtccacgccctaaacgatgcgaactggatgttggtctcaactcggagatcagtgtcgaagctaacgcgttaagttcgccgcctggggagtacggtcgcaagactgaaactcaaaggaattgacgggggcccgcacaagcggtggagtatgtggtttaattcgatgcaacgcgaagaaccttacctggccttgacatgtccggaatccagcagagatgcaggagtgccttcgggaatcggaacacaggtgctgcatggctgtcgtcagctcgtgtcgtgagatgttgggttaagtcccgcaacgagcgcaacccttgtccttagttgccagcgagtaatgtcgggaactctaaggagactgccggtgacaaaccggaggaaggtggggatgacgtcaagtcatcatggcccttacggccagggctacacacgtactacaatggtcggtacagagggttgcgataccgcgaggtggagctaatcccagaaagccgatcccagtccggattggagtctgcaactcgactccatgaagtcggaatcgctagtaatcgcagatcagctatgctgcggtgaatacgttcccgggccttgtacacaccgcccgtcacaccatgggagtgagctgctccagaagccgttagtctaaccgcaagggggacgacgaccacggagtggttcatgactggggtgaagtcgtaacaaggtaacc

SEQ ID NO: 362 - DNA, 725 bp, Klebsiella variicola
aacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctagagagatctgggagtgctcgaaagagaaccgatacacaggtgctgcatggctgtcgtcagctcgtgtcgtgagatgttgggttaagtcccgcaacgagcgcaacccttgtccttagttgctacgcaagagcactctagggagactgccggtgacaaaccggaggaaggtggggatgacgtcaagtcctcatggcccttatgggtagggcttcacacgtcatacaatggtcggaacagagggtcgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtaacc

SEQ ID NO: 363 - DNA, 730 bp, Klebsiella pneumoniae
aacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcatcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaacc

SEQ ID NO: 364 - DNA, 726 bp, Pseudomonas plecoglossicida
aacaggattagataccctggtagtccacgccctaaacgatgtcgactggttgttgggccttgagtggctcagtaacgaagctaacgcgtgaagtcgaccgcctggggagtacggccgcaaggttgaaactcaaaggaattgacggggacccgcacaagcggtggatgatgtggtttaattcgatgcaacgcgaaaaaccttacctacccttgacatggcaggaatcctgcagagatgtgggagtgctcgcaagagagcctgcacacaggtgctgcatggctgtcgtcagctcgtgtcgtgagatgttgggttaagtcccgcaacgagcgcaacccttgccattagttgctacgaaagggcactctaatgggactgccggtgacaaaccggaggaaggtggggatgacgtcaagtcctcatggcccttatgggtagggctacacacgtcatacaatggccggtacagagggctgccaacccgcgagggggagccaatccctacaaaaccggtcgtagtccggattgcagtctgcaactcgactgcatgaagtcggaatcgctagtaatcgcggatcagcatgccgcggtgaatacgttcccgggtcttgtacacaccgcccgtcacaccatgggagcgggttctgccagaagtgggtagcctaaccgcaaggagggcgcttaccacggcagggttcgtgactggggtgaagtcgtaacaaggtaacc

SEQ ID NO: 365 - DNA, 730 bp, Stenotrophomonas pavanii
aacaggattagataccctggtagtccacgccgtaaacgatgtcgacttgggggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccctatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaacc

SEQ ID NO: 366 - DNA, 730 bp, Sphingomonas echinoides
aacaggattagataccctggtagtccacgccgtaaacgatgtcgacttgaaggctgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaacgttgggttaagtcccgcaacgagcgcaacccttatcctttgttgccagcggtccggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaacc

SEQ ID NO: 367 - DNA, 732 bp, Rhizobium massiliae
aacaggattagataccctggtagtccacgccctaaacgatgcgaactggatgttgggtgcaacttggcactcagtatcgaagctaacgcgttaagttcgccgcctgggaagtacggtcgcaagactgaaactcaaaggaattgacgggggcccgcacaagcggtggagtatgtggtttaattcgatgcaacgcgcagaaccttacctggccttgacatccagggaaccttgcagagatgcgagggtgccttcgggaaccctgagacaggtgctgcatggctgtcgtcagttcgtgtcgtgagatgttgggttaagtcccgcaacgagcgcaacccttgtccttagttgccagcacttcgggtgggaactctaaggagaccgccggcgacaagccggaggaaggtggggatgacgtcaagtcatcatggcccttacggccagggctacacacgtactacaatggtggggacagagggctgcgaagccgcgaggcggagccaatcccagaaaccccatctcagtccggattggagtctgcaactcgactccatgaagtcggaatcgctagtaatcgcagatcagcattgctgcggtgaatacgttcccgggccttgtacacaccgcccgtcacaccatgggagtctgttgcaccagaagcaggtagcttaaccttcgggagggcgcttgccacggtgtggccgatgactggggtgaagtcgtaacaaggtaacc

SEQ ID NO: 368 - DNA, 730 bp, Serratia marcescens
aacaggattagataccctggtagtccatgccgtaaacgatgagtgctaagtgttgggaggtttccgcctctcagtgctgcagctaacgcattaagcactccgcctggggagtacgaccgcaaggttgaaactcaaaggaattgacgggggcccgcacaagcggtggagcatgtggtttaattcgaagcgacgcgaagaaccttaccaggtcttgacatccatagccagtctaagagattagatgttcccttcggggactatgagacaggtggtgcatggctgtcgtcagctcgtgtcgtgagatgttgggttaagtcccgcaacgagcgcaacccttgtcattagttgccagcattaagttgggcactctaatgagactgccggtgacaaaccggaggaaggtggggatgacgtcaagtcatcatgccccttatgacctgggctacacacgtgctacaatggacggtacaacgagaagcgaccctgtgaaggcaagcggatctctgaaagccgttctcagttcggattgcaggctgcaactcgcctgcatgaagctggaatcgctagtaatcgcaaatcagcacgttgcggtgaatacgttcccgggccctgtacacaccgcccgtcacaccatgagagtttgtaacgcccgaagccggcgggataaccgaaaggagtcagccgtctaaggcgggacagatgattagggtgaagtcgtaacaaggtaacc

SEQ ID NO: 369 - DNA, 730 bp, Sphingomonas echinoides
aacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggctcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaacc

SEQ ID NO: 370 - DNA, 730 bp, Sphingomonas dokdonensis; identical to SEQ ID NO: 358

SEQ ID NO: 371 - DNA, 731 bp, Pantoea dispersa
aacaggattagataccctggtagtccacgccgtaaacgatgtcgacttggaggttgtgccccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaacc

SEQ ID NO: 372 - DNA, 730 bp, Luteibacter anthropi
aacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaacctccgggagggcgcttaccactttgtgattcatgactggggtgaagtcgtaacaaggtaacc

SEQ ID NO: 373 - DNA, 730 bp, Burkholderia gladioli; identical to SEQ ID NO: 358

SEQ ID NO: 374 - DNA, 730 bp, Leclercia adecarboxylata; identical to SEQ ID NO: 358

SEQ ID NO: 375 - DNA, 730 bp, Tepidimonas aquatic
aacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaagttttcagagatgagaatgtgccttcgggaaccgtgggacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctgcacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaacc

SEQ ID NO: 376 - DNA, 730 bp, Tatumella morbirosei
aacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgttgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaacc

SEQ ID NO: 377 - DNA, 733 bp, Enterobacter cancerogenus
aacaggattagataccctggtagtccacgccctaaacgatgcgaactggatgttgggttcaacttggaacccagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggtcttgacatccacggaactttccagagatggattggtgccttcgggaaccgtgagacaggtgctgcatggctgtcgtcagctcgtgtcgtgagttgctgggttaagtcccgcaacgagcgcaacccttgtccttagttgccagcacgtaatggtgggaactctaaggagaccgccggtgacaaaccggaggaaggtggggatgacgtcaagtcatcatggcccttacgaccagggctacacacgtactacaatgggaaggacagagggctgcaatcccgcgagggggagccgatcccagaaaccttctctcagtccggatcggagtctgcaactcgactccgtgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgcttgccacggtgtggccgatgactggggtgaagtcgtaacaaggtaacc

SEQ ID NO: 378 - DNA, 731 bp, Thermomonas brevis
aacaggattagataccctggtagtccacgccgtaaacgatgtctactagtcgttgggtcccttgaggacttagtgacgcagctaacgcaataagtagaccgcctggggagtacggccgcaaggttaaaactcaaatgaattgacgggggcccgcacaagcggtggagcatgtggtttaattcgatgcaacgcgaagaaccttacctggtcttgacatatctagaatcctgcagagatgcgggagtgccttcgggaattagaatacaggtgctgcatggctgtcgtcagctcgtgtcgtgagatgttgggttaagtcccgcaacgagcgcaacccttgtccttagttaccagcggtttggccgggaactctaaggatactgccagtgacaaactggaggaaggcggggacgacgtcaagtcatcatggcccttacgaccagggctacacacgtgctacaatggtaggtacagagggcagctacacagcgatgtgatgcgaatctcaaaaagcctatcgtagtccagattggagtctgcaactcgactccatgaagtaggaatcgctagtaatcgcggatcagaatgccgcggtgaatacgttcccgggccttgtacacaccgcccgtcacaccatgggagttgattgcaccagaagtggttagcctaaccttttaggaaggcgatcaccacggtgtggttgatgactggggtgaagtcgtaacaaggtaacc

SEQ ID NO: 379 - DNA, 729 bp, Lactobacillus iners
aacaggattagataccctggtagtccacgccctaaacgatgtcaactggttgttgggtcttcactgactcagtaacgaagctaacgcgtgaagttgaccgccgggggagtacggccgcaaggttgaaactcaaaggaattgacggggacccgcacaagcggtggatgatgtggtttaattcgatgcaacgcgaaaaaccttacccacctttgacatgtacggaattcgccagagatggcttagtgctcgaaagagagccgtaacacaggtgctgcatggctgtcgtcagctcgtgtcgtgagatgttgggttaagtcccgcaacgagcgcaacccttgtcattagttgctacattcagttgggcactctaatgagactgccggtgacataccggaggaaggtggggatgacgtcaagtcctcatggcccttataggtggggctacacacgtcatacaatggctggtacaaagggttgccaacccgcgagggggagctaatcccataaaaccagtcgtagtccggatcgcagtctgcaactcgactgcgtgaagtcggaatcgctagtaatcgtggatcagaatgtcacggtgaatacgttcccgggtcttgtacacaccgcccgtcacaccatgggagcgggttctgccagaagtagttagcttaaccgcaaggagggcgattaccacggcagggttcgtgactggggtgaagtcgtaacaaggtaacc

SEQ ID NO: 380 - DNA, 730 bp, Pantoea dispersa
aacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcgtatacaaagagaagcgacctcgcgagagccagcggacctcataaagtacgtcgtagtccggattggagtctgcaactcgactccatgaagtcggaatcgctagtaatcgtagatcagaatgctacggtgaatacgttcccgggccttgtacacactgcccgtcacaccatgggagtgggttgcaaaagaagtaggtagcttaaccttcgggagggcgcttaccactttgtgattcatgactggggtgaagtcgtaacaaggtaacc

SEQ ID NO: 381 - DNA, 732 bp, Sphingomonas echinoides
aacaggattagataccctggtagtccacgccgtaaacgatggatgctagccgttggcgagcttgctcgtcagtggcgcagctaacgctttaagcatcccgcctggggagtacggtcgcaagattaaaactcaaaggaattgacgggggcccgcacaagcggtggagcatgtggtttaattcgaagcaacgcgcagaaccttaccaacctttgacatgtccagtatggggaccagagatggaccccttcagttcggctggctggaacacaggtgctgcatggctgtcgtcagctcgtgtcgtgagatgttgggttaagtcccgcaacgagcgcaaccctcgcccttagttgccatcattcagttgggcactctaaggggactgccggtgataagccgcgaggaaggtggggatgacgtcaagtcctcatggcccttacaggttgggctacacacgtgctacaatggcggtgacaatgggcagcgaaggggcgacctggagctaatcccaaaaagccgtctcagttcagattgcactctgcaactcgagtgcatgaaggcggaatcgctagtaatcgtggatcagaacgccacggtgaatacgttcccgggccttgtacacaccgcccgtcacaccatgggagttggtcttacccgacggcgctgcgccaaccgcaaggaggcaggcgaccacggtagggtcagcgactggggtgaagtcgtaacaaggtaacc

SEQ ID NO: 382 - DNA, 732 bp, Pantoea dispersa
aacaggattagataccctggtagtccacgccgtaaacgatgaatgccagccgttggcgagcttgctcgtcagtggcgcagctaacgctttaagcattccgcctggggagtacggtcgcaagattaaaactcaaaggaattgacgggggcccgcacaagcggtggagcatgtggtttaattcgaagcaacgcgcagaaccttaccagcctttgacatgtcccgtatgattgccagagatggccttcttcagttcggctggcgggaacacaggtgctgcatggctgtcgtcagctcgtgtcgtgagatgttgggttaagtcccgcaacgagcgcaaccctcgcccctagttgccatcatttggttgggcactctagggggactgccggtgataagccgagaggaaggtggggatgacgtcaagtcctcatggcccttacgggctgggctacacacgtgctacaatggcggtgacaaagggcagcgaacccgcgagggggagctaatcctaaaaagccgtctcagttcagattgcactctgcaactcgagtgcatgaaggcggaatcgctagtaatcgtggatcagaacgccacggtgaatacgttcccgggccttgtacacaccgcccgtcacaccatgggagttggtcttacccgacggcgctgcgccaaccgcaaggaggcaggcgaccacggtagggtcagcgactggggtgaagtcgtaacaaggtaacc

SEQ ID NO: 383 - DNA, 730 bp, Pantoea agglomerans
aacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccggtgataaaccggaggaaggtggggatgacgtcaagtcatcacggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaacc

SEQ ID NO: 384 - DNA, 730 bp, Sphingomonas echinoides
aacaggattagataccctggtagtccacgctgtaaacgatgaatgctagccgttggggtgcatgcacctcagtggcgccgctaacgctttaagcattccgcctggggagtacggtcgcaagattaaaactcaaaggaattgacgggggcccgcacaagcggtggagcatgtggtttaattcgaagcaacgcgcagaaccttaccatcccttgacatggcatgcgaaccggagagatccggtgttcccttcggggacgtgcacacaggtgctgcatggctgtcgtcagctcgtgtcgtgagatgttgggttaagtcccgcaacgagcgcaacccacgtcctcagttgccatcattcagttgggcactctggggagactgccggtgataagccgcgaggaaggtgtggatgacgtcaagtcctcatggcccttacgggatgggctacacacgtgctacaatggcggtgacaatgggcagcgaaggggcgacctggagcgaatccccaaaagccgtctcagttcggattgcactctgcaactcgggtgcatgaaggcggaatcgctagtaatcgtggatcagcatgccacggtgaatacgttcccgggccttgtacacaccgcccgtcacaccatgggagttggtcttacccgacggcgctgcgccaactggcaacaggggcaggcgaccacggtagggtcagcgactggggtgaagtcgtaacaaggtaacc

SEQ ID NO: 385 - DNA, 730 bp, Sphingomonas echinoides
aacaggattagataccctggtagtccacgccgtaaacgatgtcgacttggaggttgtgcccttgaggcgtggcttccggagctaacgcgttaagtcgaccgcctggggagtacggccgcaaggttaaaactcagatgaattgacgggggcccgcacaagcggtggagcatgtggtttaattcgatgcaacgcgaagaaccttacctactcttgacatccagagaacttggcagagatgctttggtgccttcgggaactctgagacaggtgctgcatggctgtcgtcagctcgtgttgtgaaatgttgggttaagtcccgcaacgagcgcaacccctatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtagatcagaatgctacggtgaatacgttcccgggccttgtacacaccgcccgtcacaccatgggagtgggttgcaaaagaagtagatagcttaaccttcgggagggcgtttaccactttgtgattcatgactggggtgaagtcgtaacaaggtaacc

SEQ ID NO: 386 - DNA, 725 bp, Shigella flexneri
aacaggattagataccctggtagtccacgccctaaacgatgtcaactagttgtcgggtcttcattgacttggtaacgtagctaacgcgtgaagttgaccgcctgggaagtacggtcgcaagattaaaactcaaaggaattgacggggacccgcacaagcggtggatgatgtggattaattcgatgcaacgcggaaaaccttacctacccttgacatgtatggaatcctgctgagaggtgggagtgcccgaaagggagccataacacaggtgctgcatggctgtcgtcagctcgtgtcgtgagatgttgggttaagtcccgcaacgagcgcaacccttgtccctagttgctacgcaagagcactctagggagactgccggtgacaaaccggaggaaggtggggatgacgtcaagtcctcatggcccttacgggtagggcttcacacgtcatacaatggtcggaacagagggtcgccaacccgcgagggggagccaatcccagaaaaccgatcgtagtccggatcgcactctgcaactcgagtgcgtgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtaacc

SEQ ID NO: 387 - DNA, 725 bp, Leclercia adecarboxylata
aacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcccgctgagaggtgggagtgctcgaaagagaaccggcgcacaggtgctgcatggctgtcgtcagctcgtgtcgtgagatgttgggttaagtcccgcaacgagcgcaacccttgtccttagttgctacgcaagagcactctaaggagactgccggtgacaaaccggaggaaggtggggatgacgtcaagtcctcatggcccttatgggtagggcttcacacgtcatacaatggtcggaacagagggttgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtaacc

SEQ ID NO: 388 - DNA, 725 bp, Pseudoxanthomonas kaohsiungensis
aacaggattagataccctggtagtccacgccctaaacgatgtcaactggttgttgggtcttcactgactcagtaacgaagctaacgcgtgaagttgaccgcctggggagtacggccgcaaggttgaaactcaaaggaattgacggggacccgcacaagcggtggatgatgtggtttaattcgatgcaacgcgaaaaaccttacccacctttgacatgtacggaatcctttagagatagaggagtgctcgaaagagagccgtaacacaggtgctgcatggctgtcgtcagctcgtgtcgtgagatgttgggttaagtcccgcaacgagcgcaacccttgccattagttgctacgaaagggcactctaatgggactgccggtgacaaaccggaggaaggtggggatgacgtcaagtcctcatggcccttataggtggggctacacacgtcatacaatggctggtacagagggttgccaacccgcgagggggagctaatcccataaagccagtcgtagtccggatcgcagtctgcaactcgactgcgtgaagtcggaatcgctagtaatcgcggatcggaatgtcgcggtgaatacgttcccgggtcttgtacacaccgcccgtcacaccatgggagcgggttctgccagaagtaggtagcctaaccgtaaggagggcgcttaccacggcagggttcgtgactggggtgaagtcgtaacaaggtaacc

SEQ ID NO: 389 - DNA, 730 bp, Psychrobacter pulmonis
aacaggattagataccctggtagtccacgctgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcatatacaaagagaagcgacctcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaacc

SEQ ID NO: 390 - DNA, 730 bp, Variovorax boronicumulans
aacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttggcagagatgctttggtgccttcgggaactccgagacaggtgctgcatggctgtcgtcagcccgtgttgtgaaatgttgggttaagtcccgcaacgagcgcaacccttatcctttgttgccagcggttcggccgggaactcaaaggagactgccagtgataaactggaggaaggtggggatgacgccaagtcatcatggcccttacgagtagggctacacacgtgctacaatggcgtatacaaagagaagcgacctcgcgagagcaagcggacctcataaagtacgtcgtagtccggattggagtctgcaactcgactccatgaagtcggaatcgctagtaatcgtagatcagaatgctacggtgaatacgttcccgggccttgtacacaccgcccgtcacaccatgggagtgggtcgcaaaagaagtagatagcttaaccttcgggagggcgtttaccactttgtgattcatgactggggcgaagtcgtaacaaggtaacc

SEQ ID NO: 391 - DNA, 732 bp, Enterobacter sp.
aacaggattagataccctggtagtccatgccgtaaacgatgtctactagccgttggggcctttgaggctttagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggtcttgacatagtaagaactttccagagatggattggtgccttcgggaacttacatacaggtgctgcatggctgtcgtcagctcgtgtcgtgaggtgttgggttaagtcccgcaacgagcgcaacccttttccttatttgccagcgggttaagccgggaactttaaggatactgccagtgacaaactggaggaaggcggggacgacgtcaagtcatcatggcccttacgaccagggctacacacgtgctacaatggtcggtacaaagggttgctacctagcgataggatgctaatctcaaaaagccgatcgtagtccggattggagtctgcaactcgactccatgaagtcggaatcgctagtaatcgcggatcagaatgccgcggtggatacgttcccgggccttgtacacaccgcccgtcacaccatgggagtttgttgcaccagaagtaggtagtctaaccgcagggaggacgcttaccacggtgtggccgatgactgggggtgaagtcgtaacaaggtaacc

SEQ ID NO: 392 - DNA, 730 bp, Microvirga aerophilus
aacaggattagataccctggtagtccatgccgtaaacgatgtctactagccgttgggggatttgatcctttagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggccttgacatagtagagactttccagagatggattggtgccttcgggaatctacatacaggtgctgcatggctgtcgtcagctcgtgtcgtgagatgttgggttaagtcccgcaacgagcgcaacccttttccttacttgccagcatttcggatgggaactttaaggatactgccagtgacaaactggaggaaggcggggacgacgtcaagtcatcatggcccttacggccagggctacacacgtgctacaatggtcggtacaaagggttgctacacagcgatgtgatgctaatctcaaaaagccgatcgtagtccggatcgcagtctgcaactcgactgcgtgaagtcggaatcgctagtaatcgcggatcagaatgccgcggtgaatacgttcccgggccttgtacacaccgcccgtcacaccatgggagtttgttgcaccagaagtaggtagtctaaccgcaaggaggacgcttaccacggtgtggccgatgactggggtgaagtcgtaacaaggtaacc

SEQ ID NO: 393 - DNA, 731 bp, Microvirga aerilata
aacaggattagataccctggtagtccatgccgtaaacgatgtctactagccgttggggcctttgaggctttagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggtcttgacatagtaagaactttccagagatggattggtgccttcgggaacttacatacaggtgctgcatggctgtcgtcagctcgtgtcgtgagatgttgggttaagtcccgcaacgagcgcaacccttttccttatttgccagcgggttaagccgggaactttaaggatactgccagtgacaaactggaggaaggcggggacgacgtcaagtcatcatggcccttacgaccagggctacacacgtgctacaatggtcggtacaaagggttgctacctagcgataggatgctaatctcaaaaagccgatcgtagtccggattggagtctgcaactcgactccatgaagtcggaatcgctagtaatcgcggatcagaatgccgcggtgaatacgttcccgggccttgtacacaccgcccgtcacaccatgggaatttgttgcaccagaagtaggtagtctaaccgcaaggaggacgcttaccacggtgtggccgatgactggggtgaagtcgtaacaaggtaacc

SEQ ID NO: 394 - DNA, 731 bp, Erwinia aphidicola
aacaggattagataccctggtagtccacgccgtaaacgatgtctactagccgttggggtccttgagactttagtggcgcagttaacgcgataagtagaccgcctggggagtacggccgcaaggttaaaactcaaatgaattgacgggggcccgcacaagcggtggagcatgtggtttaattcgatgcaacgcgaagaaccttacctggtcttgacatagtaagaactttccagagatgggttggtgccttcgggaacttacatacaggtgctgcatggctgtcgtcagctcgtgtcgtgaggtgttgggttaagtcccgcaacgagcgcaacccttttccttatttgccagcgggttaagccgggaactttaaggatactgccagtgacaaactggaggaaggcggggacgacgtcaagtcatcatggcccttacgaccagggctacacacgtgctacaatggtcggtacaaagggttgctacctagcgataggatgctaatctcaaaaagccgatcgtagtccggattggagtctgcaactcgactccatgaagtcggaatcgctagtaatcgcggatcagaatgccgcggtgaatacgttcccgggccttgtacacaccgcccgtcacaccatgggagtttgttgcaccagaagtaggtagtctaaccgcaaggaggacgcttaccacggtgtggccgatgactggggtgaagtcgtaacaaggtaacc

SEQ ID NO: 395 - DNA, 730 bp, Methylobacterium platani
aacaggattagataccctggtagtccacgccgtaaacgatgtcgactagccgttgggtccttcgcggactttgtggcgcagttaacgcgataagtcgaccgcctggggagtacggccgcaaggttaaaactcaaatgaattgacgggggcccgcacaagcggtggagcatgtggtttaattcgatgcaacgcgaagaaccttacctactcttgacatcctgcgaacccttcggagacgaaggggtgccttcgggaacgcagagacaggtgctgcatggctgtcgtcagctcgtgttgtgaaatgttgggttaagtcccgtaacgagcgcaacccttgtccctatttgccagcgattcggtcgggaactctagggagactgccggtgacaaaccggaggaaggtggggacgacgtcaagtcatcatggcccttacgggtaggactacacacgtgctacaatggtcagtacaaagggttgcgaacttgcgagagtgagccaatcccagaaagctgatctcagtccggatcggagtctgcaactcgactccgtgaagtcggaatcgctagtaatcgtgaatcagaatgtcacggtgaatacgttcccgggccttgtacacaccgcccgtcacaccatgggagtggactgcaccagaagtggttagcctaaccttcgggagggcgatcaccacggtgtggttcatgactggggtgaagtcgtaacaaggtaacc

SEQ ID NO: 396 - DNA, 730 bp, Tatumella morbirosei
aacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaacc

SEQ ID NO: 397 - DNA, 730 bp, Burkholderia phytofirmans
aacaggattagataccctggtagtccatgccgtaaacgatgagtgctaagtgttgggaggtttccgcctctcagtgctgcagctaacgcattaagcactccgcctggggagtacgaccgcaaggttgaaactcaaaggaattgacgggggcccgcacaagcggtggagcatgtggtttaattcgaagcgacgcgaagaaccttaccaggtcttgacatccatagccagtctaagagattagatgttcccttcgggaactatgagacaggtggtgcatggctgtcgtcagctcgtgtcgtgagatgttgggttaagtcccgcaacgagcgcaacccttgtcattagttgccagcattaagttgggcactctaatgagactgccggtgacaaaccggaggaaggtggggatgacgtcaagtcatcatgccccttatgacctgggctacgcacgtgctacaatggacggtacaacgagaagcgaccctgtgaaggcaagcggatctctgaaagccgttctcagttcggattgcaggctgcaactcgcctgcatgaagctggaatcgctagtaatcgcaaatcagcacgttgcggtgaatacgttcccgggccttgtacacaccgcccgtcacaccatgagagtttgtaacgcccgaagccggcgggataaccgaaaggagtcagccgtctaaggcgggacagatgattagggtgaagtcgtaacaaggtaacc

SEQ ID NO: 398 - DNA, 732 bp, Burkholderia sp.
aacaggattagataccctggtagtccacgccgtaaacgatgagtgctaagtgttagagggtttccgccctttagtgctgcagctaacgcattaagcactccgcctggtgagtacggtcgcaagactgaaactcaaaggaattgacgggggcccgcacaagcggtggagcatgtggtttaattcgaagcaacgcgaagaaccttaccaggtcttgacatcctctgataactctagagatagagcgttccccttcgggggacagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatggtacaaagggctgcaagaccgcgaggtcaagccaatcccataaaaccattcccagttcggattgtaagctgcaactcgcctacatgaagctggaatcgctagtaatcgcggatcagcatgccgcggtgaatacgttcccgggccttgtacacaccgcccgtcacaccacgagagtttgtaacacccgaagtcggtggagtaaccgtaaggagctagccgcctaaggtgggacagatgattggggtgaagtcgtaacaaggtaacc

SEQ ID NO: 399 - DNA, 732 bp, Acidovorax temperans
aacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgacccttctagagatagaagtttccccttcgggggacaaagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacaatacaaagggcagcgaaaccgcgaggtcaagcaaatcccataaagttgttctcagttcggattgtagtctgcaactcgactacatgaagctggaatcgctagtaatcgtagatcagcgtgctacggtgaatacgttcccgggtcttgtacacaccgcccgtcacaccacgagagtttgtaacacccgaagccggtggagtaaccatttggagctagccgtcgaaggtgggacaaatgattggggtgaagtcgtaacaaggtaacc

SEQ ID NO: 400 - DNA, 732 bp, Serratia marcescens
aacaggattagataccctggtagtccacgccgtaaacgatgagtgctaagtgttaggggggttccgccccttagtgctgcagctaacgcattaagcactccgcctggggattacgaccgcaaggttgaaactcaaaggaattgacggggacccgcacaagcggtggagcatgtggtttaattcgaagcaacgcgaagaaccttaccaaatcttgacatcctctgatccctctagagatagagttttccccttcgggggacagagtgacaggtggtgcatggttgtcgtcagatcgtgtcgtgagatgttgggttaagtcccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacaatacaaagggtagcaaaaccgcgaggtcaagcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccttttggagctagccgtcgaaggtgggacaaatgattggggtgaagtcgtaacaaggtaacc

SEQ ID NO: 401 - DNA, 723 bp, Serratia ureilytica
aacaggattagataccctggtagtccacgccgtaaacgatgaatgctaggtgttgggggtcaaacctcggtgccgaagttaacacattaagcattccgcctggggagtacgcacgcaagtgtgaaactcaaaggaattgacggggacccgcacaagcagcggagcatgtggtttaattcgatgcaacgcgaagaaccttaccagggcttgacatgtgggtgaaaggtatagagatatacccctctctttatgagacatccatacaggtggtgcatggttgtcgtcagctcgtgtcgtgagatgttgggttaagtcccgcaacgagcgcaacccctatactcagttaccagcgaataaagtcggggactctaagtagactgccgatgacaaatcggaggaaggtggggatgacgtcaaatcatcatgccctttatgtcctgggctacacacgtgctacaatggttggtacagagggaagctatatagtgatataatgcaaaactccaaagccaatcccagttcggattgtaggctgcaactcgcctacatgaagtcggagttgctagtaatcgcggatcagaatgtcgcggtgaatgcgttcccgggtcttgtacacaccgcccgtcacaccatgggagttgataatacccgaagcctgtgacctaattgaggagcagtcgaaggtaggattgatgactggggtgaagtcgtaacaaggtaacc

SEQ ID NO: 402 - DNA, 727 bp, Acinetobacter beijerinckii
aacaggattagataccctggtagtccacactgtaaacgatgattactaggtgtgggaggtctgaccccttccgtgccgcagttaacgcaataagtaatccacctggggagtacgaccgcaaggttgaaactcaaaggaattgacgggggcccgcacaagcagtggattatgtggtttaattcgaagcaacgcgaagaaccttaccaggtcttgacatccaactaacgaactagagatagattaggtgcccttcggggaaagttgagacaggtggtgcatggttgtcgtcagctcgtgtcgtgagatgttgggttaagtcccgcaacgagcgcaacccctgccattagttgctacgcaagagcactctaatgggaccgctaccgacaaggtggaggaaggtggggacgacgtcaaatcatcatgccccttatgacctgggctacacacgtaatacaatggccgttaacagaaggaagcgaaggcgcgagccggagcaaacccccaaaaacggtctcagttcggattgcaggctgcaactcgcctgtatgaagtcggaattgctagtaatcgcggatcagcatgccgcggtgaatacgttcccgggccttgtacacaccgcccgtcacaccatgggagtttgtaacacccgaagccagtagcctaaccgtaaggagggcgctgtcgaaggtgggataagcgactggggtgaagtcgtaacaaggtaacc

SEQ ID NO: 403 - DNA, 731 bp, Acinetobacter junii
aacaggattagataccctggtagtccacgccgtaaacgatgagtgctaggtgttggagggtttccgcccttcagtgccgcagttaacgcattaagcactccgcctggggagtacgaccgcaaggttgaaactcaaaggaattgacggggacccgcacaagcggtggagcatgtggttcaattcgaagcaacgcgaagaaccttaccaagtcttgacatcctttgaccaccctagagatagggttttcccttcggggacaaagtgacaggtggtgcatggttgtcgtcagctcgtgtcgtgagatgttgggttaagtcccgcaacgagcgcaacccctattattagttgccagcatttagttgggcactctaatgagactgccggtgacaaaccggaggaaggtggggatgacgtcaaatcagcatgccccttatgacttgggctacacacgtgctacaatggatggtacaacgagtcgcaaacccgcgagggcaagcaaatctcttaaagccattctcagttcggattgcaggctgcaactcgcctgcatgaagccggaatcgctagtaatcgtggatcagcacgccacggtgaatacgttcccgggtcttgtacacaccgcccgtcacaccacgagagtttgtaacacccgaagtcggtgaggtaacctttatggagccagccgccgaaggtggcacagatgattggggtgaagtcgtaacaaggtaacc

SEQ ID NO: 404 - DNA, 733 bp, Acinetobacter johnsonii
aacaggattagataccctggtagtccacgccgtaaacggtgggcactaggtgtgggggacattccacgttctccgtgccgtagctaacgcattaagtgccccgcctggggagtacggccgcaaggctaaaactcaaaggaattgacgggggcccgcacaagcggcggagcatgcggatttattcgatgcaacgcgaagaaccttacctgggtttgacatctgccggaagcattcagagatgggtgtgcctttttggtcggttgacaggtggtgcatggctgtcgtcagctcgtgtcgtgagatgttgggttaagtcccgcaacgagcgcaaccctcgtcctatgttgccagtacgtgatggtgggaactcatgggagactgccggggtcaactcggaggaaggtggggatgacgtcaagtcatcatgccccttatgtccagggcttcacgcatgctacaatggctggtacaaagggttgcgatcccgtgagggtgagcgaatcccgtaaagccagtctcagttcggattggggtctgcaactcgaccccatgaagtcggagtcgctagtaatcgcagatcagcattgctgcggtgaatacgttcccgggccttgtacacaccgcccgtcaagtcatgaaagtcggtaacacccgaagccggtggcctaacccttgtggggggagccgtcgaaggtgggatcggtaattaggactaagtcgtaacaaggtaacc

SEQ ID NO: 405 - DNA, 735 bp, Acinetobacter kyonggiensis
aacaggattagataccctggtagtccacgctgtaaacggtgggtactaggtgtggggtccattccacgggttccgtgccgtagctaacgctttaagtaccccgcctggggagtacggccgcaaggctaaaactcaaaggaattgacggggccccgcacaagcggcggagcatgcggattaattcgatgcaacgcgtagaaccttacctgggtttgacatggatcgggagcgctcagagatgggtgtgcctcttttggggtcggttcacaggtggtgcatggctgtcgtcagctcgtgtcgtgagatgttgggttaagtcccgcaacgagcgcaacccttgttcactgttgccagcacgttatggtggggactcagtggagaccgccggggtcaactcggaggaaggtggggatgacgtcaagtcatcatgccccttatgtccagggcttcacgcatgctacaatggctggtacagagagtggcgagcctgtgagggtgagcgaatctcggaaagccggtctcagttcggattggggtctgcaactcgacctcatgaagtcggagtcgctagtaatcgcagatcagcaacgctgcggcgaatacgttcccggggcttgtacacaccgcccgtcaagtcatgaaagttggtaacacccgaagccggtggcctaaccgttgtgggggagccgtcgaaggtgggactggtgattaggactaagtcgtaacaaggtaacc

SEQ ID NO: 406 - DNA, 738 bp, Halomonas daqingensis
aacaggattagataccctggtagtccatgccgtaaacgatgagtgttcgcccttggtctgtctacgctacgctacgcggatcaggggcccagctaacgcgtgaaacactccgcctggggagtacggtcgcaagaccgaaactcaaaggaattgacgggggcctgcacaagcgatggagtatgtggctcaattcgatgcaacgcgaagaaccttacctggccttgacatgcatatggtagaagggtgaaagcctgacgaggtagcaataccagtatgcacaggtgctgcatggctgtcgtcagctcgtgtcgtgagatgttgggttaagtcccgcaacgagcgcaacccctgtgtcctgttgccacccggtcgcaagactggagcactctggacagactgcctcgcttaaacgaggaggaaggtggggatgacgtcaagtcagtatggcccttacggccagggctgcacacgtactacaatggctggtacaaagggaagctagaccgtcaggtggagcaaatcccccaaaaccagccccagttcagattgtcgtctgcaactcgacggcatgaagctggaatcgctagtaatggcgcatcagctacggcgccgtgaatacgttcccaggccttgtacacaccgcccgtcacatcatgaaagccgtttgtacccgaagtcgttcctcgcgaacgccgaaggtatgaatggtgattgggatgaagtcgtaacaaggtaacc

SEQ ID NO: 407 - DNA, 708 bp, Pantoea dispersa
aacaggattagataccctggtagtccacgccgtaaacgatggttgctagttgtcgggctgcatgcagttcggtgacgcagctaacgcattaagcaatccgcctggggagtacggtcgcaagattaaaactcaaaggaattgacgggggcccgcacaagcggtggagcatgtggtttaattcgaagcaacgcgcagaaccttaccaccttttgacatgcctggaccgccacggagacgtggctttcccttcggggactaggacacaggtgctgcatggctgtcgtcagctcgtgtcgtgagatgttgggttaagtcccgcaacgagcgcaaccctcgccattagttgccatcatttagttgggaactctaatgggactgccggtgctaagccggaggaaggtggggatgacgtcaagtcctcatggcccttacagggtgggctacacacgtgctacaatggcaactacagagggttaatccttaaaagttgtctcagttcggattgtcctctgcaactcgagggcatgaagttggaatcgctagtaatcgcggatcagcatgccgcggtgaatacgttcccgggccttgtacacaccgcccgtcacactatgggagttggttctacccgaaggcggtgcgctaaccagcaatggaggcagccgaccacggtagggtcagcgactggggtgaagtcgtaacaaggtaacc

SEQ ID NO: 408 - DNA, 708 bp, Lactobacillus iners
aacaggattagataccctggtagtccacgccgtaaacgatgattgctagttgtcgggctgcatgcagttcggtgacgcagctaacgcattaagcaatccgcctggggagtacggtcgcaagattaaaactcaaaggaattgacgggggcccgcacaagcggtggagcatgtggtttaattcgaagcaactcgcagaaccttaccaccttttgacatgcctggaccgccacggagacgtggctttctcttcggggactaggacacaggtgctgcatggctgtcgtcagctcgtgtcgtgagatgttgggttaagtcccgcaacgagcgcaaccctcgccattagttgccatcatttagttgggaactctaatgggactgccggtgctaagccggaggaaggtggggatgacgtcaagtcctcatggcccttacagggtgggctacacacgtgctacaatggctactacagagggttaatccttaaaagtagtctcagttcggattgtcctctgcaactcgagggcatgaagttggaatcgctagtaatcgcggatcagcatgccgcggtgaatacgttcccgggccttgtacacaccgcccgtcacaccatgggagttggttctacccgaaggcggtgcgctaaccagcaatggaggcagccgaccacggtagggtcagcgactggggtgaagtcgtaacaaggtaacc

SEQ ID NO: 409 - DNA, 730 bp, Bacillus aryabhattai; identical to SEQ ID NO: 355

SEQ ID NO: 410 - DNA, 732 bp, Staphylococcus hominis
aacaggattagataccctggtagtccacgccgtaaacgatgataactagctgtctgggggcttagctcttaggtggcgcagctaacgcattaagttatccgcctggggagtacggccgcaaggttaaaactcaaatgaattgacgggggcctgcacaagcggtggagcatgtggtttaattcgaagcaacgcgcagaaccttaccagcgtttgacatgtccggacgatttccagagatggatctcttcccttcggggactggaacacaggtgctgcatggctgtcgtcagctcgtgtcgtgagatgttgggttaagtcccgcaacgagcgcaaccctcgactttagttaccatcatttagttgggtactctaaagtaaccgccggtgataagccggaggaaggtggggatgacgtcaagtcctcatggcccttacgcgctgggctacacacgtgctacaatggcaactacagtgggcagcaatcccgcgagggtgagctaatctccaaaagttgtctcagttcggattgttctctgcaactcgagagcatgaaggcggaatcgctagtaatcgcggatcagcatgccgcggtgaatacgttcccaggccttgtacacaccgcccgtcacaccatgggagttgggttcacccgaaggcgttgcgctaactcgcaagagaggcaggcgaccacggtgggcttagcgactggggtgaagtcgtaacaaggtaacc

SEQ ID NO: 411 - DNA, 733 bp, Staphylococcus capitis
aacaggattagataccctggtagtccacgccgtaaacgatgatgactagctgtcggggcgcttagcgtttcggtggcgcagctaacgcgttaagtcatccgcctggggagtacggccgcaaggttaaaactcaaagaaattgacgggggcctgcacaagcggtggagcatgtggtttaattcgaagcaacgcgcagaaccttaccagcgtttgacatggtaggacggtttctggagacagattccttcccttacgggacctacacacaggtgctgcatggctgtcgtcagctcgtgtcgtgagatgttgggttaagtcccgcaacgagcgcaaccctcgtctttagttgctatcatttagttgggcactctaaagaaactgccggtgataagccggaggaaggtggggatgacgtcaagtcctcatggcccttacgcgctgggctacacacgtgctacaatggcggtgacagagggctgcaaacccgcgagggtgagctaatctccaaaaaccgtctcagttcggattgttctctgcaactcgagagcatgaaggcggaatcgctagtaatcgcggatcagcacgccgcggtgaatacgttcccaggccttgtacacaccgcccgtcacaccatggagttgggttcacccgaaggcgttgcgctaacctcgcaagaggaggcaagcgaccacggtgggcttagcgactggggtgaagtcgtaacaaggtaacc

SEQ ID NO: 412 - DNA, 729 bp, Finegoldia magna
aacaggattagataccctggtagtccacgccctaaacgatgtcaactggttattgggtcttcactgactcagtaacgaagctaacgcgtgaagttgaccgcctggggagtacggccgcaaggttgaaactcaaaggaattgacggggacccgcacaagcggtggatgatgtggtttaattcgatgcaacgcgaaaaaccttacccacctttgacatgtacggaatcctttagagatagaggagtgctcgaaagagagccgtaacacaggtgctgcatggctgtcgtcagctcgtgtcgtgagatgttgggttaagtcccgcaacgagcgcaacccttgtcattagttgctacatttagttgagcactctaatgagactgccggtgacaaaccggaggaaggtggggatgacgtcaagtcctcatggcccttataggtggggctacacacgtcatacaatggctggtacagagggttgccaacccgcgagggggagccaatcccataaagccagtcgtagtccggatcgcagtctgcaactcgactgcgtgaagtcggaatcgctagtaatcgcggatcagaatgtcgcggtgaatacgttcccgggtcttgtacacaccgcccgtcacaccatgggagcgggttctgccagaagtagttagcctaaccgcaaggagggcgattaccacggcagggttcgtgactggggtgaagtcgtaacaaggtaacc

SEQ ID NO: 413 - DNA, 725 bp, Ruminococcus bromii
aacaggattagataccctggtagtccatgccctaaacgatgtcaactggttgttgggaattcactttctcagtaacgaagctaacgcgtgaagttgaccgcctggggagtacggccgcaaggttgaaactcaaaggaattgacggggacccgcacaagcggtggatgatgtggtttaattcgatgcaacgcgaaaaaccttacccacctttgacatgtacggaagactgcagagatgcggttgtgctcgaaagagagccgtaacacaggtgctgcatggctgtcgtcagctcgtgtcgtgagatgttgggttaagtcccgcaacgagcgcaacccttgccattagttgctacgaaagggcactctaatgggactgccggtgacaaaccggaggaaggtggggatgacgtcaagtcctcatggcccttataggtggggctacacacgtcatacaatggctggtacagagggttgccaacccgcgagggggagccaatcccacaaagccagtcgtagtccggatcgcagtctgcaactcgactgcgtgaagtcggaatcgctagtaatcgcggatcagaatgtcgcggtgaatacgttcccgggtcttgtacacaccgcccgtcacaccatgggagcgggttctgccagaagtaggtagcctaaccgtaaggagggcgcttaccacggcagggttcgtgactggggtgaagtcgtaacaaggtaacc

SEQ ID NO: 414 - DNA, 732 bp, Aerococcus urinaeequi
aacaggattagataccctggtagtccacgccgtaaacgatgaatgttagccgtcggcatgcatgcatgtcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatgtcggtcgcggtttccagagatggattccttcagttaggctggaccgaacacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagacagcgatgtcgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaagcgatgcgctaaccgcaaggaggcagtcgaccacggtagggtcagcgactggggtgaagtcgtaacaaggtaacc

SEQ ID NO: 415 - DNA, 725 bp, Propioniciclava tarda
aacaggattagataccctggtagtccacgccctaaacgatgtcaactggttgttgggagggtttcttctcagtaacgtagctaacgcgtgaagttgaccgcctggggagtacggccgcaaggttgaaactcaaaggaattgacggggacccgcacaagcggtggatgatgtggtttaattcgatgcaacgcgaaaaaccttacctacccttgacatgccaggaatcttgcagagatgtgagagtgctcgaaagagaacctggacacaggtgctgcatggccgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaggtcatcatggcccttatgggtagggctacacacgtcatacaatggccgggacagagggctgccaacccgcgagggggagctaatcccagaaacccggtcgtagtccggatcgcagtctgcaactcgactgcgtgaagtcggaatcgctagtaatcgcggatcagcttgccgcggtgaatacgttcccgggtcttgtacacaccgcccgtcacaccatgggagcgggttctgccagaagtagttagcctaaccgcaaggagggcgattaccacggcagggttcgtgactggggtgaagtcgtaacaaggtaacc

SEQ ID NO: 416 - DNA, 725 bp, Propionibacterium acnes
aacaggattagataccctggtagtccacgccctaaacgatgtcaactggttgttgggagggtttcttctcagtaacgtagctaacgcgtgaagttgaccgcctggggagtacggccgcaaggttgaaactcaaaggaattgacggggacccgcacaagcggtggatgatgtggtttaattcgatgcaacgcgaaaaaccttacctacccttgacatgtcaggaatcttgcagagatgtgagagtgctcgaaagagaacctggacacaggtgctgcatggccgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaggtcatcatggcccttatgggtagggctacacacgtcatacaatggccgggacagagggctgccaacccgcgagggggagctaatcccagaaacccggtcgtagtccggatcgcagtctgcaactcgactgcgtgaagtcggaatcgctagtaatcgcggatcagcttgccgcggtgaatacgttcccgggtcttgtacacaccgcccgtcacaccatgggagcgggttctgccagaagtagttagcctaaccgcaaggagggcgattaccacggcagggttcgtgactggggtgaagtcgtaacaaggtaacc

SEQ ID NO: 417 - DNA, 731 bp, Unknown
  source: /note="Description of Unknown: Uncultured seed derived bacterium of the family Chromatiaceae"
aacaggattagataccctggtagtccacgccgtaaacgatgtctactagctgttcgtggtcttgtactgtgagtagcgcagctaacgcactaagtagaccgcctggggagtacggtcgcaagattaaaactcaaatgaattgacgggggcccgcacaagcggtggagcatgtggtttaattcgacgcaacgcgaagaaccttacctactcttgacatctagcgaagattgtagagatacgattgtgccttcgggaacgctaagacaggtgctgcatggctgtcgtcagctcgtgttgtgaaatgttgggttaagtcccgcaacgagcgcaacccttatccttagttgccagcacgtaatggtgggaactctagggagactgccggtgataaaccggaggaaggtggggacgacgtcaagtcatcatggcccttacgagtagggctacacacgtgctacaatggtatgtacagagggaggcaagctggcgacagtgagcggatctcttaaagcatatcgtagtccggatcgcagtctgcaactcgactgcgtgaagtcggaatcgctagtaatcgcaaatcagaatgttgcggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaacc

SEQ ID NO: 418 - DNA, 731 bp, Brevundimonas diminuta
aacaggattagataccctggtagtgcacgccgtaaacgatgtctactagctgttcgtggtcttgtactgtgagtagcgcagctaacgcactaagtagaccgcctggggagtacggtcgcaagattaaaactcaaatgaattgacgggggcccgcacaagcggtggagcatgtggtttaattcgacgcaacgcgaagaaccttacctactcttgacatctacggaagactgcagagatgcggttgtgccttcgggaaccgtaagacaggtgctgcatggctgtcgtcagctcgtgttgtgaaatgttgggttaagtcccgcaacgagcgcaacccctatccttagttgccagcacgtaatggtgggaactctagggagactgccggtgataaaccggaggaaggtggggacgacgtcaagtcatcatggcccttacgagtagggctacacacgtgctacaatggtacgtacagagggaggcaagctggcgacagtgagcggatctcttaaagcgtatcgtagtccggatcgcagtctgcaactcgactgcgtgaagtcggaatcgctagtaatcgcaaatcagaatgttgcggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaacc

SEQ ID NO: 419 - DNA, 731 bp, Brevundimonas naejangsanensis
aacaggattagataccctggtagtccatgccgtaaacgatgtctactagccgttggggcctttgaggctttagtggcgcagctaacgcgataagcagaccgcctggggagtacggtcgcaagactaaaactcaaatgaattgacgggggcccgcacaagcggtggagcatgtggtttaattcgatgcaacgcgaagaaccttacctggtcttgacatagtaagaactttccagagatggattggtgccttcgggaacttacatacaggtgctgcatggctgtcgtcagctcgtgtcgtgagatgttgggttaagtcccgcaacgagcgcaacccttttccttatttgccatcgggttaagccgggaactttaaggatactgccagtgacaaactggaggaaggcggggacgacgtcaagtcatcatggcccttacgaccagggctacacacgtgctacaatggtcggtacaaagggttgctacctagcgataggatgctaatctcaaaaagccgatcgtagtccggattggagtctgcaactcgactccatgaagtcggaatcgctagtaatcgcggatcagaatgccgcggtgaatacgttcccgggccttgtacacaccgcccgtcacaccatgggaatttgttgcaccagaagtaggtagtctaaccgcaaggaggacgcttaccacggtgtggccgatgactggggtgaagtcgtaacaaggtaacc

SEQ ID NO: 420 - DNA, 731 bp, Sphingomonas echinoides
aacaggattagataccctggtagtccatgccgtaaacgatgtctactagccgttggggcctttgaggctttagtggcgcagctaacgcgataagtagaccgcctggggagtacggtcgcaagactaaaactcaaatgaattgacgggggcccgcacaagcggtggagcatgtggtttaatttgatgcaacgcgaagaaccttacctggccttgacatactaagaactttccagagatggattggtgccttcgggaacttagatacaggtgctgcatggctgtcgtcagctcgtgtcgtgagatgttgggttaagtcccgcaacgagcgcaacccttttccttatttgccatcgggtaatgccgggaactttaaggatactgccagtgacaaactggaggaaggcggggacgacgtcaagtcatcatggcccttacggccagggctacacacgtgctacaatggtcggtacaaagggttgctacctcgcgagaggatgctaatctcaaaaagccgatcgtagtccggatcgcagtctgcaactcgactgcgtgaagtcggaatcgctagtaatcgcggatcagaatgccgcggtgaatacgttcccgggccttgtacacaccgcccgtcacaccatgggagtttgttgcaccagaagtaggtagtctaaccgcaaggaggacgcttaccacggtgtggccgatgactggggtgaagtcgtaacaaggtaacc

SEQ ID NO: 421 - DNA, 731 bp, Sphingomonas koreensis
aacaggattagataccctggtagtccatgccgtaaacgatgtctactagccgttggggcctttgaggctttagtggcgcagctaacgcgataagtagaccgcctgaggagtacggtcgcaagactaaaactcaaatgaattgacgggggcccgcacaagcggtggagcatgtggtttaattcgatgcaacgcgaagaaccttacctggtcttgacatagtaagaactttccagagatggattggtgccttcgggaacttacatacaggtgctgcatggctgtcgtcagctcgtgtcgtgagatgttgggttaagtcccgcaacgagcgcaacccttttccttatttgccagcgggttaagccgggaactttaaggatactgccagtgacaaactggaggagggcggggacgacgtcaagtcatcatggcccttacgaccagggctacacacgtgctacaatggtcggtacaaagggttgctacctcgcgagaggatgctaatctcaaaaagccgatcgtagtccggattggagtctgcaactcgactccatgaagtcggaatcgctagtaatcgcggatcagaatgccgcggtgaatacgttcccgggccttgtacacaccgcccgtcacaccatgggagtttgttgcaccagaagtaggtagtctaaccgtaaggaggacgcttaccacggtgtggcagatgactggggtgaagtcgtaacaaggtaacc

SEQ ID NO: 422 - DNA, 731 bp, Sphingomonas humi
aacaggattagataccctggtagtccacgccgtaaacgatgtcgaccagccgttgggatccttgagatcttagtggcgcagctaacgcattaagtcgaccgcctggggagtacggccgcaaggttaaaactcaaatgaattgacgggggcccgcacaagcggtggagcatgtggtttaattcgaagcaacgcgaagaaccttaccaggccttgacatgcagagaactttccagagatggattggtgccttcgggaactctgacacaggtgctgcatggctgtcgccagctcgtgtcgtgagatgttgggttaagtcccgtaacgagcgcaacccttgtccttagttaccagcacgttaaggtgggcactctaaggagactgccggtgacaaaccggaggaaggtggggatgacgtcaagtcatcatggcccttacggcctgggctacacacgtgctacaatggtcggtacaaagggttgccaagccgcgaggtggagctaatcccataaaaccgaccgtagtccggatcgcagtctgcaactcgactgcgtgaagtcggaatcgctagtaatcgtgaatcagaatgtcacggtgaatacgttcccgggccttgtacacaccgcccgtcacaccatgggagtgggttgctccagaagtagctagtctaaccttcggggggacggttaccacggagtgattcatgactggggtgaagtcgtaacaaggtaacc

SEQ ID NO: 423 - DNA, 733 bp, Acidovorax facilis
aacaggattagataccctggtagtccacgccctaaacgatgcgaactggatgttgggtgcaatttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggccttgacatgcacggaactttccagagatggattggtgccttcgggaaccgtgacacaggtgctgcatggctgtcgtcagctcgtgtcgtgagatgttgggttaagtcccgcaacgagcgcaacccttgtccttagttgccagcacgtaatggtgggaactctaaggagaccgccggcgacaagccggaggaaggtggggatgacgtcaagtcatcatggcccttacggccagggctacacacgtactacaatggtggggacagagggttgcgataccgcgaggtggagccaatctcagaaaccccatcccagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccgcaaggggggcgcttgccacggtgtggccgatgactggggtgaagtcgtaacaaggtaacc

SEQ ID NO: 424 - DNA, 725 bp, Acidovoraz temperans
aacaggattagataccctggtagtccacgccctaaacgatgtcaactagttgttggggattcatttccttagtaacgtagctaacgcgtgaagttgaccgcctggggagtacagtcgcaagattaaaactcaaaggaattgacggggacccgcacaagcggtggatgatgtggattaattcgatgcaacgcgagaaaccttacctacccttgacatggtcggaatcccgctgagaggtgggagtgctcgaaagagaaccggcgcacaggtgctgcatggctgtcgtcagctcgtgtcgtgagatgttgggttaagtcccgcaacgagcgcaacccttgtccttagttgctacgcaagagcactctaaggagactgccggtgacaaaccggaggaaggtggggatgacgtcaagtcctcatggcccttatgggtagggcttcacacgtcatacaatggtcggaacagagggttgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtaacc

SEQ ID NO: 425 - DNA, 730 bp, Shinella zoogloeoides
aacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatcctcggaagttttcagagatgagaatgtgccttcgggaaccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaacc

SEQ ID NO: 426 - DNA, 731 bp, Roseateles depolymerans
aacaggattagataccctggtagtccacgccgtaaacgatgtctactagccgttgggagccttgagctcttagtggcgcagctaacgcactaagtagaccgcctggggagtacggtcgcaagattaaaactcaaatgaattgacgggggcccgcacaagcggtggagcatgtggtttaattcgacgcaacgcgaagaaccttaccaggtcttgacatccagagaactttccagagatggattggtgccttcgggaactctgagacaggtgctgcatggctgtcgtcagctcgtgtcgtgagatgttgggttaagtcccgtaacgagcgcaacccttgtccttagttgccagcgcgtaatggcgggaactctaaggagactgccggtgacaaaccggaggaaggtggggatgacgtcaagtcatcatggcccttacgacctgggctacacacgtgctacaatgggcggtacaaagggttgccaaaccgcgaggtggagctaatcccgtaaaaccgttcgtagtccggattggagtctgcaactcgactccatgaagtcggaatcgctagtaatcgcaaatcagaacgttgcggtgaatacgttcccgggccttgtacacaccgcccgtcacaccatgggagtgggttgcaaaagaagtagctagtctaaccgcaagggggacggttaccactttgtgattcatgactggggtgaagtcgtaacaaggtaacc

SEQ ID NO: 427 - DNA, 730 bp, Roseateles terrae; identical to SEQ ID NO: 389

SEQ ID NO: 428 - DNA, 725 bp, Rheinheimera chironomi
aacaggattagataccctggtagtccacgccctaaacgatgtcaactggctgttgggtgcgagagtactcagtagcgaagctaacgcgtgaagttgaccgcctggggagtacggccgcaaggttgaaactcaaaggaattgacgggggcccgcacaagcggtggatgatgtggattaattcgatgcaacgcgaagaaccttacctgctcttgacatgccaggaactttccagagatggattggtgcccgaaagggaacctggacacaggtgctgcatggctgtcgtcagctcgtgtcgtgagatgttgggttaagtcccgcaacgagcgcaacccttgccattagttgctacgaaagggcactctaatgggactgccggtgacaaaccggaggaaggtggggatgacgtcaagtcctcatggcccttatgagcagggcttcacacgtcatacaatggtcggtacagagggtagccaacccgcgagggggagccaatcccagaaaaccgatcgtagtccggattgcagtctgcaactcgactgcatgaagtcggaatcgctagtaatcgcaggtcagcatactgcggtgaatacgttcccgggccttgtacacaccgcccgtcacaccatgggagtaggttgctccagaagtaggtagcctaaccgcaaggggggcgcttaccacggagtgattcatgactggggtgaagtcgtaacaaggtaacc

SEQ ID NO: 429 - DNA, 733 bp, Rheinheimera soli
aacaggattagataccctggtagtccacgccctaaacgatgcgaactggatgttgggtgcaactaggcactcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggccttgacatgcacggaactttccagagatggattggtgccttcgggaaccgtgacacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacggccagggctacacacgtactacaatgggaaggacagagggctgcaatcccgcgagggggagccaatcccagaaaccttctctcagtccggatcggagtctgcaactcgactccgtgaagtcggaatcgctagtaatcgcagatcagcattgctgcggtgaatacgttcccgggccttgtacgcaccgcccgtcacaccatgggagtgggttgcaccagaagtagctagtctaaccttcgggaggacggttaccacggtgtgattcatgactggggtgaagtcgtaacaaggtaacc

SEQ ID NO: 430 - DNA, 734 bp, Acinetobacter johnsonii
aacaggattagataccctggtagtccacgccgtaaacgatgataactagctgtcggggcccatagggtttcggtggcgcagctaacgcattaagttatccgcctggggagtacggccgcaaggttaaaactcaaagaaattgacgggggcctgcacaagcggtggagcatgtggtttaattcgaagcaacgcgcagaaccttaccagcgtttgacatcctcatcgcgggatccagagatggattccttcagttcggctggatgagtgacaggtgctgcatggctgtcgtcagctcgtgtcgtgagatgttgggttaagtcccgcgacgagcgcaaccctcgtccttagttgccatcatttagttgggcactctaaggaaaccgccggtgataagccggaggaaggtggggatgacgtcaagtcctcatggcccttacgcgctgggctacacacgtgctacaatggcggtgacagtgggcagcaaacccgcgagggtgagctaatctccaaaagccgtctcagttcggattgttctctgcaactcgagagcatgaaggcggaatcgctagtaatcgcggatcagcacgccgcggtgaatacgttcccaggccttgtacacaccgcccgtcacaccatgggagttggattgacccgaaggcgctgagctaacccgcaagggaggcaggcgaccacggtcggttcagcgactggggtgaagtcgtaacaaggtaacc

SEQ ID NO: 431 - DNA, 732 bp, Acinetobacter schindleri
aacaggattagataccctggtagtccacgccctaaacgatgaatactagatgtttggtgccaagcgtactgagtgtcgtagctaacgcgataagtattccgcctgggaagtacggccgcaaggttaaaactcaaaggaattgacgggggcccgcacaagcggtggagcatgtggtttaattcgatgcaacgcgaagaaccttacctgggcttgacatgtctggaatcctgcagagatgcgggagtgcccttcggggaatcagaacacaggtgctgcatggctgtcgtcagctcgtgtcgtgagatgttgggttaagtcccgcaacgagcgcaacccttgtccttagttgccagcggttcggccgggcactctagggagactgccggtgacaaaccggaggaaggtggggatgacgtcaagtcctcatggcctttatgtccagggctacacacgtgctacaatggcgcgtacagagggaagccaagccgcgaggtggagcagaccccagaaagcgcgtcgtagttcggattgcagtctgcaactcgactgcatgaagtcggaatcgctagtaatcgcggatcagcatgccgcggtgaatacgttcccgggccttgtacacaccgcccgtcacaccatgggagtggattgtaccagaagccgttagcctaaccttcgggagggcgatgaccacggtatggttcatgactggggtgaagtcgtaacaaggtaacc

SEQ ID NO: 432 - DNA, 725 bp, Acinetobacter lwoffii
aacaggattagataccctggtagtccacgccctaaacgatgtcaactggttgttgggtcttcactgactcagtaacgaagctaacgcgtgaagttgaccgcctggggagtacggccgcaaggttgaaactcaaaggaattgacggggacccgcacaagcggtggatgatgtggtttaattcgatgcaacgcgaaaaaccttacccacctttgacatgtacggaagttaccagagatggtttcgtgctcgaaagagaaccgtaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttataggtggggctacacacgtcatacaatggctggtacagagggttgccaacccgcgagggggagctaatcccataaaaccagtcgtagtccggatcgcagtctgcaactcgactgcgtgaagtcggaatcgctagtaatcgcggatcagaatgtcgcggtgaatacgttcccgggtcttgtacacaccgcccgtcacaccatgggagcgggttctgccagaagtagttagcctaaccgcaaggagggcgattaccacggcagggttcgtgactggggtgaagtcgtaacaaggtaacc

SEQ ID NO: 433 - DNA, 729 bp, Pseudomonas stutzeri
aacaggattagataccctggtagtccacgccgtaaactatgagagctagccgttggagggtttacccttcagtggcgcagctaacgcattaagctctccgcctggggagtacggtcgcaagattaaaactcaaaggaattgacgggggcccgcacaagcggtggagcatgtggtttaattcgaagcaacgcgaagaaccttaccagcccttgacatggcaggacgacttccagagatggatttcttcccttcggggacctgcacacaggtgctgcatggctgtcgtcagctcgtgtcgtgagatgttgggttaagtcccgcaacgagcgcaaccctcgcctttagttgccatcattcagttgggcactctagagggattgccggtgataagccggaggaaggtggggatgacgtcaagtcttcatggcccttacgggctgggctacacacgtgctacaatggcggtgacagagggttgctacacagcgatgtgatgctaatcccaaaaagccgtctcagttcggattgcactctgcaactcgagtgcatgaagtcggaatcgctagtaaccgcagatcagcacgctgcggtgaatacgttcccgggccttgtacacaccgcccgtcacaccatgggagttggttctacccgaagccggtgcgctaaccgcaaggaagcagccgaccacggtagggtcagcgactggggtgaagtcgtaacaaggtaacc

SEQ ID NO: 434 - DNA, 726 bp, Thermomonas koreensis
aacaggattagataccctggtagtccacgccctaaacgatgtcaactggttgttgggagggtttcttctcagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgccactaacgaagcagagatgcatcaggtgcccgaaagggaaagtggacacaggtgctgcatggctgtcgtcagctcgtgtcgtgagatgttgggttaagtcccgcaacgagcgcaacccttgtctctagttgctacgcaagggcactctagagagactgccggtgacaaaccggaggaaggtggggatgacgtcaagtcctcatggcccttatgggtagggcttcacacgtcatacaatggtgcgtacagagggttgccaacccgcgagggggagctaatcccagaaaacgcatcgtagtccggatcgtagtctgcaactcgactacgtgaagctggaatcgctagtaatcgcggatcagcatgccgcggtgaatacgttcccgggtcttgtacacaccgcccgtcacaccatgggagtgggttttgccagaagtagttagcctaaccgcaaggagggcgattaccacggcagggttcatgactggggtgaagtcgtaacaaggtaacc

SEQ ID NO: 435 - DNA, 728 bp, Burkholderia sp.
aacaggattagataccctggtagtccacgccgtaaacgatgaatgccagccgttggcctgcttgcaggtcagtggcgccgctaacgcattaagcattccgcctggggagtacggtcgcaagattaaaactcaaaggaattgacgggggcccgcacaagcggtggagcatgtggtttaattcgaagcaacgcgcagaaccttaccatcccttgacatggcatgttagctcgagagatcgggtgtcctcttcggaggcgtgcacacaggtgctgcatggctgtcgtcagctcgtgtcgtgagatgttgggttaagtcccgcaacgagcgcaacccacgtccttagttgccatcattcagttgggcactctagggagactgccggtgataagccgcgaggaaggtgtggatgacgtcaagtcctcatggcccttacgggatgggctacacacgtgctacaatggcggtgacagagggacgcgaaaccgcgaggttgagcaaatccccaaaagccgtctcagttcggattgcactctgcaactcgggtgcatgaaggcggaatcgctagtaatcgtggatcagcacgccacggtgaatacgttcccgggccttgtacacactgcccgtcacaccatgggagttggtcttacccgacggcgctgcgccaaccgcaaggaggcaggcgaccacggtagggtcagcgactggggtgaagtcgtaacaaggtaacc

SEQ ID NO: 436 - DNA, 733 bp, Shigella flexneri
aacaggattagataccctggtagtccacgccctaaacgatgcgaactggacgttgggcacacttaggtgctcagtgtcgaagctaacgcgttaagttcgccgcctggggagtacggtcgcaagactgaaactcaaaggaattgacgggggcccgcacaagcggtggagtatgtggtttaattcgatgcaacgcgaagaaccttacctggccttgacatgtccggaatcctgcagagatgcgggagtgccttcgggaatcggaacacaggtgctgcatggctgtcgtcagctcgtgtcgtgagatgttgggttaagtcccgcaacgagcgcaacccttgtccttagttgccagcacgtaatggtgggaactctaaggagactgccggtgacaaaccggaggaaggtggggatgacgtcaagtcatcatggcccttacggccagggctacacacgtactacaatggtcggtacagagggttgcaaagccgcgaggtggagccaatcccagaaagccgatctcagtccggatcggagtctgcaactcgactccgtgaagtcggaatcgctagtaatcgcggatcagcattgtcgcggtgaatacgttcccgggccttgtacacaccgcccgtcacaccatgggagtgggttgctccagaagcaggtagcgtaaccgcaaggagcgcgcttgccacggagtggttcatgactggggtgaagtcgtaacaaggtaacc

SEQ ID NO: 437 - DNA, 730 bp, Cellvibrio mixtus
aacaggattagataccctggtagtccatgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagctttcccttcggggacaaagtgacaggtggtgcatggttgtcgtcagctcgtgtcgtgagatgttgggttaagtcccgcaacgagcgcaacccttattattagttgccagcattcagttgggcactctagtgagactgccggtgataaaccggaggaaggtggggatgacgtcaaatcatcatgccccttatgacctgggctacacacgtgctacaatggatggtacaacgagtcgcaaaaccgcgaggttaagctaatctcttaaagccattctcagttcggattgtaggctgcaattcgcctacatgaagccggaatcgctagtaatcgcggatcagaacgccgcggtgaatacgttcccgggccttgtacacaccgcccgtcacaccacgagagtttgtaacacccaaagtcggtgaggtaaccttcgggagccagccgcctaaggtgggacagataattggggtgaagtcgtaacaaggtaacc

SEQ ID NO: 438 - DNA, 736 bp, Serratia marcescens
aacaggattagataccctggtagtccatgccgtaaacgttgggcactaggtgtgggggacattccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacattcaccggaccgccccagagatggggtttcccttcggggctggtggacaggtggtgcatggttgtcgtcagctcgtgtcgtgagatgttgggttaagtcccgcaacgagcgcaaccctcgttctatgttgccagcacgtgatggtggggactcataggagactgccggggtcaactcggaggaaggtggggatgacgtcaaatcatcatgccccttatgtcttgggcttcacgcatgctacaatggccggtacaaagggttgcgatactgtgaggtggagctaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcacgaaagttggtaacacccgaagccggtggcctaaccccctgtgggagggagccgtcgaaggtgggactggcgattgggactaagtcgtaacaaggtaacc

SEQ ID NO: 439 - DNA, 735 bp, Thiobacillus aquaesulis
aacaggattagataccctggtagtccatgccgtaaacggtgggtactaggtgtggggctccttccacggactccgtgccgtagctaacgcattaagtaccccgcctggggagtacggccgcaaggctaaaactcaaagaaattgacgggggcccgcacaagcggcggagcatgtggattaattcgatgcaacgcgaagaaccttacctgggtttgacatacaccagaaagccgtagagatacggccccccttgtggttggtgtacaggtggtgcatggctgtcgtcagctcgtgtcgtgagatgttgggttaagtcccgcaacgagcgcaacccttatcttatgttgccagcgcgtaatggcggggactcgtgagagactgccggggtcaactcggaggaaggtggggacgacgtcaagtcatcatgccccttatgtccagggcttcacacatgctacaatggccggtacagagggctgcgataccgtgaggtggagcgaatcccttaaagccggtctcagttcggatcggggtctgcaactcgaccccgtgaagttggagtcgctagtaatcgcagatcagcaacgctgcggtgaatacgttcccgggccttgtacacaccgcccgtcacgtcatgaaagtcggtaacacccgaagccggtggcctaaccccttgtgggagggagccgtcgaaggtgggatcggcgattgggacgaagtcgtaacaaggtaacc

SEQ ID NO: 440 - DNA, 736 bp, Luteimonas aestuarii
aacaggattagataccctggtagtccacgccgtaaacggtgggcgctaggtgtgggggccattccacggtctctgtgccgcagctaacgcattaagcgccccgcctggggagtacggccgcaaggctaaaactcaaaggaattgacgggggcccgcacaagcggcggagcatgtggattaattcgatacaacgcgaagaaccttacctgggtttgacatgcaccagacgcgtccagagatgggcgttcccttgtggctggtgtgcaggtggtgcatggctgtcgtcagctcgtgtcgtgagatgttgggttaagtcccgcaacgagcgcaaccctcgttccatgttgccagcgggttatgccggggactcatgggagactgccggggtcaactcggaggaaggtggggatgacgtcaagtcatcatgccccttatgtccagggcttcacacatgctacaatggcctatacagagggctgcgagaccgcaaggtggagcgaatcccttaaagtaggtctcagttcggatcggggtctgcaactcgaccccgtgaagttggagtcgctagtaatcgcagatcagcaacgctgcggtgaatacgttcccgggccttgtacacaccgcccgtcacgtcacgaaagttggtaacacccgaagccgacggcctaacccgcttgcgggagggagttgtcgaaggtgggactggcgattgggacgaagtcgtaacaaggtaacc

SEQ ID NO: 441 - DNA, 714 bp, Sphingosinicella sp.
aacaggattagataccctggtagtccacgccgtaaacgatggatactagctgttgggggcaacttcagtggctaagcgaaagtgataagtatcccacctggggagtacgaacgcaagtttgaaactcaaaggaattgacgggggcccgcacaagcggtggagcatgtggtttaattcgatgatacgcgaggaaccttaccaaggcttaaatgcagactgaccgatttggaaacagatctttcgcaagacagtttacaaggtgctgcatggttgtcgtcagctcgtgccgtgaggtgtcaggttaagtcctataacgagcgcaacccctgttgttagttgccagcgagtagtgtcgggaactctaacaagactgccagtgcaaactgtgaggaaggtggggatgacgtcaaatcatcacggcccttacgccttgggctacacacgtgctacaatggccggtacagagagcagccactgggtgaccaggagcgaatctataaagccggtcacagttcggatcggagtctgcaactcgactccgtgaagctggaatcgctagtaatcggatatcagccatgatccggtgaatacgttcccgggccttgtacacaccgcccgtcaagccatggaagctgggggtgcctgaagtcggtgaccgcaaggagctgcctagggtaaaactggtaactagggctaagtcgtaacaaggtaacc

SEQ ID NO: 442 - DNA, 719 bp, Acidithiobacillus albertensis
aacaggattagataccctggtagtccacgccctaaacgatgatgactcgatgtttgcgatataccgtaagcgtccaagcgaaagcgttaagtcatccacctggggagtacgcccgcaagggtgaaactcaaaggaattgacgggggcccgcacaagcggaggaacatgcggtttaattcgatgatacgcgaggaaccttacccgggcttgaaagttactgaagggcgcagagacgcgcccgtccttcgggacaggaaactaggtgctgcatggctgtcgtcagctcgtgccgtgaggtgttgggttaagtcccgcaacgagcgcaacccctatgtttagttgccagcacgtcaaggtggggactctaaacagactgcctgcgcaagcagagaggaaggcggggacgacgtcaagtcatcatggcccttacgtccggggctacacacgtgctacaatggatgatacagcgggcagctacacagcaatgtgatgccaatctcgaaaagccattcacagttcggatcggggtctgcaactcgaccccgtgaagttggattcgctagtaatcgcgtatcagcaatgacgcggtgaatacgttcccgggccttgtacacaccgcccgtcaagctatgaaagctgggggtacctaaagcatgtaaccgcaaggagcgtgtcagggtaagaccggtaattgggggctaagtcgtaacaaggtaacc

SEQ ID NO: 443 - DNA, 721 bp, Curvibacter gracilis
aacaggattagataccctggtagtccacgccctaaacgatggatactcgacatacgcgatacactgtgtgtgtctgagcgaaagcattaagtatcccacctgggaagtacgaccgcaaggttgaaactcaaaggaattggcgggggtccgcacaagcggtggagcatgtggtttaattcgatgatacgcgaggaaccttacctgggctagaatgcagtctgaccgtgggtgaaagctcattttgtagcaatacacagattgtaaggtgctgcatggctgtcgtcagctcgtgccgtgaggtgttgggttaagtcccgcaacgagcgcaacccccatcagtagttgccatcaggtaacgctgggaactctactgaaactgccgtcgtaagacgcgaggaaggaggggatgatgtcaagtcatcatggcctttatgcccagggctacacacgtgctacaatggggcgtacaaagggctgccacttagcgataaggagccaatcccaaaaaacgcctctcagttcagatcgcagtctgcaactcgactgcgtgaagctggaatcgctagtaatcgtatatcagcaatgatacggtgaatacgttcccggaccttgcacacaccgcccgtcaagccatggaagccgggtgtacctaaagtcggtaaccgcaaggagccgcctagggtaaaactggtaactggggctaagtcgtaacaaggtaacc

SEQ ID NO: 444 - DNA, 718 bp, Devosia insulae
aacaggattagataccctggtagtccacgccctaaacgatgatgactcgatgtttgcgatataccgtaagcgtccaagcgaaagcgttaagccatccacctggggagtacgcccgcaagggtgaaactcaaaggaattgacgggggcccgcacaagcggaggagcatgtggtttaattcgatgatacgcgaggaaccttacccgggcttgaaagttactgaagcatccagagacggatgcgtccttcgggacaggaaactaggtgctgcatggctgtcgtcagctcgtgccgtgaggtgttgggttaagtcccgcaacgagcgcaacccctatgtccagttgccagcacgtaatggtggggactctggccagactgcctgcgcaagcagagaggaaggcggggacgacgtcaagtcatcatggcccttacgtccggggctacacacgtgctacaatggatggtacagcgggcagctacacagcaatgtgatgccaatctcgaaaagccattcacagttcggatcggggtctgcaactcgaccccgtgaagttggattcgctagtaatcgcgtatcagcaatgacgcggtgaatacgttcccgggccttgtacacaccgcccgtcaagccatgaaagctgggggtacctaaagcatgtaaccgcaaggagcgtgtcagggtaaaaccggtaattggggctaagtcgtaacaaggtaacc

SEQ ID NO: 445 - DNA, 730 bp, Cupriavidus gilardii
aacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaacc

SEQ ID NO: 446 - DNA, 730 bp, Methylobacterium rhodesianum
aacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaacc

SEQ ID NO: 447 - DNA, 476 bp, Dokdonella sp.
tggctcaggacgaacgctggcggcgtgcctaatacatgcaagtcgagcggacagaagggagcttgctcccggatgttagcggcggacgggtgagtaacacgtgggtaacctgcctgtaagactgggataactccgggaaaccggagctaataccggatagttccttgaaccgcatggttcaaggatgaaagacggtttcggctgtcacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgcaagagtaactgcttgcacctgacggtacct

SEQ ID NO: 448 - DNA, 480 bp, Desemzia incerta
tggctcaggacgaacgctggcggcgtgcctaatacatgcaagtcgagcgaatcgatgggagcttgctccctgagattagcggcggacgggtgagtaacacgtgggcaacctgcctataagactgggataacttcgggaaaccggagctaataccggatacgttcttttctcgcatgagagaagatggaaagacggtttacgctgtcacttatagatgggcccgcggcgcattagctagttggtgaggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgaagaaggccttcgggtcgtaaagttctgttgttagggaagaacaagtaccagagtaactgctggtacctgacggtacctaacc

SEQ ID NO: 449 - DNA, 483 bp, Kocuria rosea
tctgctcaggatgaacgctggcggcgtgcctaatacatgcaagtcgagcgaatggattgagagcttgctctcaagaagttagcggcggacgggtgagtaacacgtgggtaacctgcccataagactgggataactccgggaaaccggggctaataccggataacattttgaactgcatggttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcacctgacggtacctacc

SEQ ID NO: 450 - DNA, 777 bp, Nocardia ignorata
tgagtaacacgtaggcaacctgccctcaagtttgggacaactaccggaaacggtagctaataccgaatagttgttttcttcgcctgaagagaactggaaagacggagcaatctgtcacttggggatgggcctgcggcgcattagctagttggtgaggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaggtgacggtacctgagaagaaagccccggctaactacgtgccagcagccgcggtaatacgtagggggcaagcgttgtccggaattattgggcgtaaagcgcgcgcaggcggtcatttaagtctggtgtttaatcccggggctcaaccccggatcgcactggaaactgggtgacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgagtgctaggtgttaggggtttcgatacccttggtgccgaagttaacacattaagcactcc

SEQ ID NO: 451 - DNA, 482 bp, Pseudonocardia aurantiaca
tggctcaggatgaacgctggcggcgtgcctaatacatgcaagtcgagcgaacggacgagaagcttgcttctctgatgttagcggcggacgggtgagtaacacgtggataacctacctataagactgggataacttcgggaaaccggagctaataccggataatattttgaaccgcatggttcaaaagtgaaagacggtcttgctgtcacttatagatggatccgcgctgcattagctagttggtaaggtaacggcttaccaaggcaacgatgcatagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacatatgtgtaagtaactgtgcacatctgacggtacctaatca

SEQ ID NO: 452 - DNA, 935 bp, Flavobacterium johnsoniae
  modified_base (481)..(481): a, c, t or g
ctcgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaacggcccacctaggcgacgatccctagctggtctgagaggatgaccagccacactggaactgagacacggtccagactcttacgggaggcagcagtggggaatattgcacaatgggcgcaagcctgatgcagccatgccgcgtgtatgaagaaggccttcgggttgtaaagtactttcagcggggaggaaggcgatgtggttaataaccgcatcgattgacgttacccgcagaagaagcaccggctaactccgtgccagcagccgcggtaatacggagggtgcaagcgttaatcggaattactgggcntaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttgg

SEQ ID NO: 453 - DNA, 939 bp, Flavobacterium mizutaii
  modified_base (387)..(387): a, c, t or g
  modified_base (425)..(425): a, c, t or g
ctcgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaacggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgtggttaataaccgcatngattgacgttaccccgcagaagaagcaccggctaactnccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtg

SEQ ID NO: 454 - DNA, 850 bp, Flavisolibacter ginsengiterrae
  modified_base (792)..(792): a, c, t or g
  modified_base (839)..(839): a, c, t or g
ggcggacgggtgagtaacacgtgggtaacctgcccataagactgggataactccgggaaaccggggctaataccggataacattttgaactgcatggttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcntggggagtacggccgcaaggctgaaactcaaaggaattgacgggggnccgcacaagcg

SEQ ID NO: 455 - DNA, 907 bp, Sphingobacterium daejeonense
tggcgaacgggtgagtaacacgtgagtaacctgcccttaactctgggataagcctgggaaactgggtctaataccggataggagcgtccaccgcatggtgggtgttggaaagatttatcggttttggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgcaagcctgatgcagcgacgccgcgtgagggatgacggccttcgggttgtaaacctctttcagtagggaagaagcgaaagtgacggtacctgcagaagaagcaccggctaactacgtgccagcagccgcggtaatacgtagggtgcgagcgttatccggaattattgggcgtaaagagctcgtaggcggtttgtcgcgtctgtcgtgaaagtccggggcttaaccccggatctgcggtgggtacgggcagactagagtgcagtaggggagactggaattcctggtgtagcggtggaatgcgcagatatcaggaggaacaccgatggcgaaggcaggtctctgggctgtaactgacgctgaggagcgaaagcatggggagcgaacaggattagataccctggtagtccatgccgtaaacgttgggcactaggtgtggggaccattccacggtttccgcgccgcagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgttctcgatcgccgtagagatacggttt

SEQ ID NO: 456 - DNA, 911 bp, Leclercia adecarboxylata
gttagcggcggacgggtgagtaacacgtgggtaacctgcccataagactgggataactccgggaaaccggggctaataccggataacattttgaactgcatggttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgaca

SEQ ID NO: 457 - DNA, 919 bp, Enterobacter cancerogenus
gcttcggccttagtggcgcacgggtgcgtaacgcgtgggaatctgccctttggttcggaataacagctggaaacggctgctaataccggatgatgacgaaagtccaaagatttatcgccagaggatgagcccgcgttggattaggtagttggtggggtaaaggcctaccaagccgacgatccatagctggtctgagaggatgatcagccacactgggactgagacacggcccagactcctacgggaggcagcagtggggaatattggacaatgggcgaaagcctgatccagcaatgccgcgtgagtgatgaaggccctagggttgtaaagctcttttacccgggaagataatgactgtaccgggagaataagccccggctaactccgtgccagcagccgcggtaatacggagggggctagcgttgttcggaattactgggcgtaaagcgcacgtaggcggctttgtaagtcagaggtgaaagcctggagctcaactccagaactgcctttgagactgcatcgcttgaatccaggagaggtcagtggaattccgagtgtagaggtgaaattcgtagatattcggaagaacaccagtggcgaaggcggctgactggactggtattgacgctgaggtgcgaaagcgtggggagcaaacaggattagataccctggtagtccacgccgtaaacgatgataactagctgtccgggcacttggtgcttgggtggcgcagctaacgcattaagttatccgcctggggagtacggccgcaaggttaaaactcaaaggaattgacgggggcctgcacaagcggtggagcatgtggtttaattcgaagcaacgcgcagaaccttaccagcgtttgacatgtccggacgatttccagagatggatctcttcccttcggggactggaacac

SEQ ID NO: 458 - DNA, 872 bp, Bacillus altitudinis
  modified_base (123)..(123): a, c, t or g
gggtgcgtaacgcgtgggaatctgccctttggttcggaataacagctggaaacggctgctaataccggatgatgacgaaagtccaaagatttatcgccagaggatgagcccgcgttggattangtagttggtggggtaaaggcctaccaagccgacgatccatagctggtctgagaggatgatcagccacactgggactgagacacggcccagactcctacgggaggcagcagtggggaatattggacaatgggcgaaagcctgatccagcaatgccgcgtgagtgatgaaggccctagggttgtaaagctcttttacccgggaagataatgactgtaccgggagaataagccccggctaactccgtgccagcagccgcggtaatacggagggggctagcgttgttcggaattactgggcgtaaagcgcacgtaggcggctttgtaagtcagaggtgaaagcctggagctcaactccagaactgcctttgagactgcatcgcttgaatccaggagaggtcagtggaattccgagtgtagaggtgaaattcgtagatattcggaagaacaccagtggcgaaggcggctgactggactggtattgacgctgaggtgcgaaagcgtggggagcaaacaggattagataccctggtagtccacgccgtaaacgatgataactagctgtccgggcacttggtgcttgggtggcgcagctaacgcattaagttatccgcctggggagtacggccgcaaggttaaaactcaaaggaattgacgggggcctgcacaagcggtggagcatgtggtttaattcgaagcaacgcgcagaaccttaccagcgtttgacatgtccggacgatttccagagatgga

SEQ ID NO: 459 - DNA, 819 bp, Bacillus simplex
  modified_base (46)..(46): a, c, t or g
ggctgctaataccggatgatgacgaaagtccaaagatttatcgccngaggatgagcccgcgttggattaggtagttggtggggtaaaggcctaccaagccgacgatccatagctggtctgagaggatgatcagccacactgggactgagacacggcccagactcctacgggaggcagcagtggggaatattggacaatgggcgaaagcctgatccagcaatgccgcgtgagtgatgaaggccctagggttgtaaagctcttttacccgggaagataatgactgtaccgggagaataagccccggctaactccgtgccagcagccgcggtaatacggagggggctagcgttgttcggaattactgggcgtaaagcgcacgtaggcggctttgtaagtcagaggtgaaagcctggagctcaactccagaactgcctttgagactgcatcgcttgaatccaggagaggtcagtggaattccgagtgtagaggtgaaattcgtagatattcggaagaacaccagtggcgaaggcggctgactggactggtattgacgctgaggtgcgaaagcgtggggagcaaacaggattagataccctggtagtccacgccgtaaacgatgataactagctgtccgggcacttggtgcttgggtggcgcagctaacgcattaagttatccgcctggggagtacggccgcaaggttaaaactcaaaggaattgacgggggcctgcacaagcggtggagcatgtggtttaattcgaagcaacgcgcagaaccttaccagcgtttgacatgtccggacgatttccagagatgga

SEQ ID NO: 460 - DNA, 919 bp, Bacillus thuringiensis
ggcgcacgggtgcgtaacgcgtgggaatctgccctttggttcggaataacagctggaaacggctgctaataccggatgatgacgaaagtccaaagatttatcgccagaggatgagcccgcgttggattaggtagttggtggggtaaaggcctaccaagccgacgatccatagctggtctgagaggatgatcagccacactgggactgagacacggcccagactcctacgggaggcagcagtggggaatattggacaatgggcgaaagcctgatccagcaatgccgcgtgagtgatgaaggccctagggttgtaaagctcttttacccgggaagataatgactgtaccgggagaataagccccggctaactccgtgccagcagccgcggtaatacggagggggctagcgttgttcggaattactgggcgtaaagcgcacgtaggcggctttgtaagtcagaggtgaaagcctggagctcaactccagaactgcctttgagactgcatcgcttgaatccaggagaggtcagtggaattccgagtgtagaggtgaaattcgtagatattcggaagaacaccagtggcgaaggcggctgactggactggtattgacgctgaggtgcgaaagcgtggggagcaaacaggattagataccctggtagtccacgccgtaaacgatgataactagctgtccgggcacttggtgcttgggtggcgcagctaacgcattaagttatccgcctggggagtacggccgcaaggttaaaactcaaaggaattgacgggggcctgcacaagcggtggagcatgtggtttaattcgaagcaacgcgcagaaccttaccagcgtttgacatgtccggacgatttccagagatggatctcttcccttcggggactggaacacaggtgctgcatggc

SEQ ID NO: 461 - DNA, 888 bp, Paenibacillus amylolyticus
cgggtgagtacacgtgggtaacctgcccataagactgggataactccgggaaaccggggctaataccggataacattttgaactgcatggttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcctgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttccag

SEQ ID NO: 462 - DNA, 914 bp, Staphylococcus aureus subsp. aureus
  modified_base (76)..(76): a, c, t or g
acgggtgagtaacacgtgggtaacctgcccataagactgggataactccgggaaaccggggctaataccggataanattttgaaccgcatggttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgaaaaccc

SEQ ID NO: 463 - DNA, 889 bp, Pantoea ananatis
gagtaacacgtgggtaacctgcccataagactgggataactccgggaaaccggggctaataccggataacattttgaactgcatggttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttctttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtc

SEQ ID NO: 464 - DNA, 882 bp, Pantoea ananatis
  modified_base (802)..(802): a, c, t or g
cgggtgagtacacgtgggtaacctgcccataagactgggataactccgggaaaccggggctaataccggataacattttgaactgcatggttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcntggctgaaactcaaaggaattgacgggggcccgcacaagcggtggagcatgtggtttaattcgaagcaacgcgaagaacc

SEQ ID NO: 465 - DNA, 899 bp, Bacillus cereus
ggcggacgggtgagtaacacgtgggtaacctgcccataagactgggataactccgggaaaccggggctaataccggataacattttgaactgcatggttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtc

SEQ ID NO: 466 - DNA, 899 bp, Pantoea ananatis
  modified_base (88)..(89): a, c, t or g
  modified_base (94)..(94): a, c, t or g
ggcggacgggtgagtaacacgtgggtaacctgcccataagactgggataactccgggaaaccggggctaataccggataacattttgnnctgcntggttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtc

SEQ ID NO: 467 - DNA, 931 bp, Bacillus cereus
  modified_base (244)..(244): a, c, t or g
gggtgagtaacacgtgggtaacctgcccataagactgggataactccgggaaaccggggctaataccggataacattttgaactgcatggttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctnctggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgaaaaccctagagatagggcttctcct

SEQ ID NO: 468 - DNA, 927 bp, Sphingomonas echinoides
gcggcggacgggtgagtaacacgtgggtaacctgcccataagactgggataactccgggaaaccggggctaataccggataacattttgaactgcatggttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgaaaaccctagaga

SEQ ID NO: 469 - DNA, 938 bp, Sphingomonas echinoides
ggcggacgggtgagtaacacgtgggtaacctgcccataagactgggataactccgggaaaccggggctaataccggataacattttgaactgcatggttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgaaaaccctagagatagggcttctcct

SEQ ID NO: 470 - DNA, 925 bp, Sphingomonas echinoides
ggcggacgggtgagtaacacgtgggtaacctgcccataagactgggataactccgggaaaccggggctaataccggataacattttgaactgcatggttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgaaaaccctagaga

SEQ ID NO: 471 - DNA, 918 bp, Sphingomonas parapaucimobilis
gttagcggcggacgggtgagtaacacgtgggtaacctgcccataagactgggataactccgggaaaccggggctaataccggataacattttgaactgcatggttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctg

SEQ ID NO: 472 - DNA, 921 bp, Bacillus cereus
gcggcggacgggtgagtaacacgtgggtaacctgcccataagactgggataactccgggaaaccggggctaataccggataacattttgaactgcatggttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgaaaaccc

SEQ ID NO: 473 - DNA, 925 bp, Bacillus cereus
gttagcggcggacgggtgagtaacacgtgggtaacctgcccataagactgggataactccgggaaaccggggctaataccggataacattttgaactgcatggttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgaaaaccc

SEQ ID NO: 474 - DNA, 937 bp, Bacillus cereus
ggcggacgggtgagtaacacgtgggtaacctgcccataagactgggataactccgggaaaccggggctaataccggataacattttgaactgcatggttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgaaaaccctagagatagggcttctcc

SEQ ID NO: 475 - DNA, 925 bp, Bacillus cereus; identical to SEQ ID NO: 470

SEQ ID NO: 476 - DNA, 923 bp, Bacillus cereus
tagcggcggacgggtgagtaacacgtgggtaacctgcccataagactgggataactccgggaaaccggggctaataccggataacattttgaactgcatggttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgaaaaccc

SEQ ID NO: 477 - DNA, 925 bp, Bacillus cereus; identical to SEQ ID NO: 470

SEQ ID NO: 478 - DNA, 747 bp, Bacillus cereus
gaatacatcggaatctaccttttcgtggggggataacgtagggaaacttacgctaataccgcatacgaccttagggtgaaagcggaggaccttcgggcttcgcgcggatagatgagccgatgtcggattagctagttggcggggtaaaggcccaccaaggcgacgatccgtagctggtctgagaggatgatcagccacactggaactgagacacggtccagactcctacgggaggcagcagtggggaatattggacaatgggcgcaagcctgatccagccatgccgcgtgggtgaagaaggccttcgggttgtaaagcccttttgttgggaaagaaaagcagtcggttaatacccgattgttctgacggtacccaaagaataagcaccggctaacttcgtgccagcagccgcggtaatacgaagggtgcaagcgttactcggaattactgggcgtaaagcgtgcgtaggtggttgtttaagtccgttgtgaaagccctgggctcaacctgggaattgcagtggatactgggcaactagagtgtggtagaggatggcggaattcccggtgtagcagtgaaatgcgtagagatcgggaggaacatctgtggcgaaggcggccatctggaccaacactgacactgaggcacgaaagcgtggggagcaaacaggattagataccctggtagtccacgccctaaacgatgcgaactggatgttgggtgcaacttggcacgcagtatcgaagc

SEQ ID NO: 479 - DNA, 611 bp, Bacillus cereus
  modified_base (91)..(91): a, c, t or g
tctcactatcggatgaacccagatgggattagctagtaggcggggtaacggcccacctaggcgacgatccctagctggtctgagaggatgnccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgtggttaataaccgcattgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgac

SEQ ID NO: 480 - DNA, 662 bp, Bacillus cereus
gtggctaataccgcataacgtcgcaagaccaaagagggggaccttcgggcctctcactatcggatgaacccagatgggattagctagtaggcggggtaacggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgtggttaataaccgcgtcgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgac

SEQ ID NO: 481 - DNA, 550 bp, Bacillus cereus
aaagtttttctgccgaaggatcggcccgcgtctgattagctagttggtgaggttatggctcaccaaggcgacgatcagtagctggtctgagaggatgatcagccacactgggactgagacacggcccagactcctacgggaggcagcagtggggaatattggacaatgggggcaaccctgatccagccatgccgcgtgagtgatgacggccttagggttgtaaagctcttttctccgggacgataatgacggtaccggaggaataagccccggctaacttcgtgccagcagccgcggtaatacgaagggggctagcgttgctcggaatcactgggcgtaaagggcgcgtaggcggctgatttagtcgagggtgaaagcccgtggctcaaccacggaatggccttcgatactgattggcttgagaccggaagaggacagcggaactgcgagtgtagaggtgaaattcgtagatattcgcaagaacaccagtggcgaaggcggctgtctggtccggttctgacgctgaggcgcgaaagcgtggggggcaaac

SEQ ID NO: 482 - DNA, 567 bp, Bacillus cereus
tctgccgaaggatcggcccgcgtctgattagctagttggtgaggttatggctcaccaaggcgacgatcagtagctggtctgagaggatgatcagccacactgggactgagacacggcccagactcctacgggaggcagcagtggggaatattggacaatgggggcaaccctgatccagccatgccgcgtgagtgatgacggccttagggttgtaaagctcttttctccgggacgataatgacggtaccggaggaataagccccggctaacttcgtgccagcagccgcggtaatacgaagggggctagcgttgctcggaatcactgggcgtaaagggcgcgtaggcggctgatttagtcgagggtgaaagcccgtggctcaaccacggaatggccttcgatactgattggcttgagaccggaagaggacagcggaactgcgagtgtagaggtgaaattcgtagatattcgcaagaacaccagtggcgaaggcggctgtctggtccggttctgacgctgaggcgcgaaagcgtggggagcaaacaggattagataccctggtagtccac

SEQ ID NO: 483 - DNA, 584 bp, Bacillus cereus
  modified_base (458)..(460): a, c, t or g
gtaaaaggcgcaccaaggcgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggatgataatgacagtaccgggagaataagctccggctaactccgtgccagcagccgcggtaatacggagggagctagcgttgttcggaattactgggcgtaaagcgcacgtaggcggctttgtaagttagaggtgaaagcctggagctcaactccagaactgcctttaagactgcatcgcttgaatccaggagaggtgagtggaattccgagtgtagaggtgaaattcgtagatattcggaagaacaccagtggcgaaggcggctcactnnnctggtattgacgctgaggtgcgaaagcgtggggagcaaacaggattagataccctggtagtccacgccgtaaacgatgataactagctgtccggggacttggtctttgggtggcgcagctaacg

SEQ ID NO: 484 - DNA, 657 bp, Bacillus cereus
tctgccctttggttcggaataacagctggaaacggctgctaataccggatgatgacgagagtccaaagatttatcgccagaggatgagcccgcgttggattaggtagttggtggggtaaaggcctaccaagccgacgatccatagctggtctgagaggatgatcagccacactgggactgagacacggcccagactcctacgggaggcagcagtggggaatattggacaatgggcgaaagcctgatccagcaatgccgcgtgagtgatgaaggccctagggttgtaaagctcttttacccgggaagataatgactgtaccgggagaataagccccggctaactccgtgccagcagccgcggtaatacggagggggctagcgttgttcggaattactgggcgtaaagcgcacgtaggcggctttgtaagtcagaggtgaaagcctggagctcaactccagaactgcctttgagactgcatcgcttgaatccaggagaggtcagtggaattccgagtgtagaggtgaaattcgtagatattcggaagaacaccagtggcgaaggcggctgactggactggtattgacgctgaggtgcgaaagcgtggggagcaaacaggattagataccctggtagtccacgccgtaaacgatgataac

SEQ ID NO: 485 - DNA, 613 bp, Bacillus cereus
cccagaggatgagccccgcgttggattaggtagttggtggggtaaaggcctaccaagccgacgattccatagctggtctgagaggatgatcagccacactgggactgagacacggcccagactcctacgggaggcagcagtggggaatattggacaatgggcgaaagcctgatccagcaatgccgcgtgagtgatgaaggccctagggttgtaaagctcttttacccgggaagataatgactgtaccgggagaataagccccggctaactccgtgccagcagccgcggtaatacggagggggctagcgttgttcggaattactgggcgtaaagcgcacgtaggcggctttgtaagtcagaggtgaaagcctggagctcaactccagaactgcctttgagactgcatcgcttgaatccaggagaggtcagtggaattccgagtgtagaggtgaaattcgtagatattcggaagaacaccagtggcgaaggcggctgactggactggtattgacgctgaggtgcgaaagcgtggggagcaaacaggattagataccctggtagtccacgccgtaaacgatgataactagctgtccgggcacttggtgcttgggtg

SEQ ID NO: 486 - DNA, 596 bp, Bacillus cereus
actgccgaaggatcggcccgcgtctgattagctagttggtgaggttacggctcaccaaggcgacgatcagtagctggtctgagaggatgatcagccacactgggactgagacacggcccagactcctacgggaggcagcagtggggaatattggacaatgggggcaaccctgatccagccatgccgcgtgagtgatgacggccttagggttgtaaagctcttttctccgggacgataatgacggtaccggaggaataagccccggctaacttcgtgccagcagccgcggtaatacgaagggggctagcgttgctcggaatcactgggcgtaaagggcgcgtaggcggctgatttagtcgagggtgaaagcccgtggctcaaccacggaatggccttcgatactggttggcttgagaccggaagaggacagcggaactgcgagtgtagaggtgaaattcgtagatattcgcaagaacaccagtggcgaaggcggctgtctggtccggttctgacgctgaggcgcgaaagcgtggggagcaaacaggattagataccctggtagtccacgctgtaaacgatgaatgctagccgttggt

SEQ ID NO: 487 - DNA, 572 bp, Bacillus cereus
  modified_base (73)..(73): a, c, t or g
ggattagctagtaggcggggtaacggcccacctaggcgacgatccctagctggtctgagaggatgaccagccncactggaactgagacacggtccagactcctacgggaggcagcagtggggaatattgcacaatgggcgcaagcctgatgcagccatgccgcgtgtatgaagaaggccttcgggttgtaaagtactttcagcggggaggacggcgatgtggttaataaccgcattgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccg

SEQ ID NO: 488 - DNA, 600 bp, Bacillus cereus
  modified_base (60)..(60): a, c, t or g
  modified_base (264)..(264): a, c, t or g
cctctcactatcggatgaaccccagatgggattagctagtaggcggggtaacggcccacntaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgtggttaataaccgcatngattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccg

SEQ ID NO: 489 - DNA, 571 bp, Xanthomonas translucens
  modified_base (353)..(353): a, c, t or g
cacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagcngaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactcc

SEQ ID NO: 490 - DNA, 702 bp, Pantoea ananatis
agactgggataactcccgggaacccggggctaataccggatggttgtttgaaccgcatggttcaaacataaaaggtggcttcggctaccacttacagatggacccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagt

SEQ ID NO: 491 - DNA, 747 bp, Pantoea ananatis
  modified_base (154)..(154): a, c, t or g
cctgtaagacttggataactcccggaaaccggggctaatacccggatggttgtttgaaccgcatggttcaaacataaaaggtggcttcggctaccacttacagatggacccgcggcgcattagctagttggtgaggtaacggctcaccaaggcnacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgca

SEQ ID NO: 492 - DNA, 706 bp, Methylobacterium aquaticum
  modified_base (133)..(133): a, c, t or g
tccgggaaaccgggctaataccggatggttgtttgaaccgcatggttcaaacataaaaggtggcttcggctaccacttacagatggacccgcggcgcattagctagttggtgaggtaacggctcaccaaggcnacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgcccc

SEQ ID NO: 493 - DNA, 678 bp, Methylobacterium aquaticum
aacctgcctgtaagactgggataacttccggaaacccggagctaataccggatagttccttgaaccgcatggttcaaggatgaaagacggtttcggctgtcacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgcaagagtaactgcttgcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagatacc

SEQ ID NO: 494 - DNA, 699 bp, Sphingomonas melonis
ttctgggataagcctgggaaactaggttttaataccggataggagcgcctaccgcatggtgggtgttggaaagatttatcggttttggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgcaagcctgatgcagcgacgccgcgtgagggatgacggccttcgggttgtaaacctctttcagtagggaagaagcgaaagtgacggtacctgcagaagaagcaccggctaactacgtgccagcagccgcggtaatacgtagggtgcgagcgttatccggaattattgggcgtaaagagctcgtaggcggtttgtcgcgtctgtcgtgaaagtccggggcttaaccccggatctgcggtgggtacgggcagactagagtgcagtaggggagactggaattcctggtgtagcggtggaatgcgcagatatcaggaggaacaccgatggcgaaggcaggtctctgggctgtaactgacgctgaggagcgaaagcatggggagcgaacaggattagataccctggtagtccatgccgtaaacgttgggcactaggtgtggggaccattccacggtttccgcgc

SEQ ID NO: 495 - DNA, 600 bp, Sphingomonas yabuuchiae
  modified_base (44)..(44): a, c, t or g
  modified_base (90)..(90): a, c, t or g
aagtccaaagatttattcgccagaggatgagccccgcgttggantaggtagttggtggggtaaaggcctaccaagccgacgatccatagntggtctgagaggatgatcagccacactgggactgagacacggcccagactcctacgggaggcagcagtggggaatattggacaatgggcgaaagcctgatccagcaatgccgcgtgagtgatgaaggccctagggttgtaaagctcttttacccgggaagataatgactgtaccgggagaataagccccggctaactccgtgccagcagccgcggtaatacggagggggctagcgttgttcggaattactgggcgtaaagcgcacgtaggcggctttgtaagtcagaggtgaaagcctggagctcaactccagaactgcctttgagactgcatcgcttgaatccaggagaggtcagttgaattccgagtgtagaggtgaaattcgtagatattcggaagaacaccagtggcgaaggcggctgactggactggtattgacgctgaggtgcgaaagcgtggggagcaaacaggattagataccctggtagtccacgccgtaaacgatgaaac

SEQ ID NO: 496 - DNA, 619 bp, Sphingomonas yabuuchiae
  modified_base (98)..(98): a, c, t or g
  modified_base (522)..(524): a, c, t or g
  modified_base (527)..(528): a, c, t or g
tgacgaaagtccaaagatttatcgcccagagggatgagcccgcgttggatttaggtagttggtgggtaaaggcctaccaagccgacgatccatagctngtctgagaggatgatcagccacactgggactgagacacggcccagactcctacgggaggcagcagtggggaatattggacaatgggcgaaagcctgatccagcaatgccgcgtgagtgatgaaggccctagggttgtaaagctcttttacccgggaagataatgactgtaccgggagaataagccccggctaactccgtgccagcagccgcggtaatacggagggggctagcgttgttcggaattactgggcgtaaagcgcacgtaggcggctttgtaagtcagaggtgaaagcctggagctcaactccagaactgcctttgagactgcatcgcttgaatccaggagaggtcagtggaattccgagtgtagaggtgaaattcgtagatattcggaagaacaccagtggcgaaggcggctgactnnnctnntattgacgctgaggtgcgaaagcgtggggagcaaacaggattagataccctggtagtccacgccgtaaacgatgataactagctgtccggg

SEQ ID NO: 497 - DNA, 1046 bp, Methylobacterium aquaticum
tggtagattgaacgctggcggcatgccttacacatgcaagtcgaacggtaacaggtcttcggatgctgacgagtggcgaacgggtgagtaatacatcggaacgtgcccaagagtgggggataacggagcgaaagctttgctaataccgcatacgatctacggatgaaagcaggggaccgcaaggccttgcgctcatggagcggccgatggcagattaggtagttggtgggataaaagcttaccaagccgacgatctgtagctggtctgagaggacgaccagccacactgggactgagacacggcccagactcctacgggaggcagcagtggggaattttggacaatgggcgcaagcctgatccagccatgccgcgtgcaggatgaaggccttcgggttgtaaactgcttttgtacggaacgaaaagcctctttctaataaagagggtcatgacggtaccgtaagaataagcaccggctaactacgtgccagcagccgcggtaatacgtagggtgcgagcgttaatcggaattactgggcgtaaagcgtgcgcaggcggtaatgtaagacagatgtgaatccccgggctcacctgggaactgcatttgtgactgcattgctggagtgcggcagagggggatggaattccgcgtgtagcagtgaaatgcgtagatatgcggaggaacaccgatggcgaaggcaatcccctgggcctgcactgacgctcatgcacgaaagcgtggggagcaaacaggattagataccctggtagtccacgccctaaacgatgtcaactggttgttgggtcttcactgactcagtaacgaagctaacgcgtgaagttgaccgcctggggagtacggccgcaaggttgaaactcaaaggaattgacggggacccgcacaagcggtggatgatgtggtttaattcgatgcaacgcgaaaaaccttacccacctttgacatgtacggaatcctttagagatagaggagtgctcgaaagagagccgtaacacaggtgctgcatggctgtcgtcagctcgtgtcg

SEQ ID NO: 498 - DNA, 588 bp, Pantoea ananatis
actgccggccgcatggtctggtggtggaaagattttttggttggggatggactcgcggcctatcagcttgttggtgaggtaatggctcaccaaggcgacgacgggtagccggcctgagaggggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggat

SEQ ID NO: 499 - DNA, 675 bp, Pantoea ananatis
aactggaaagacggagcaatctgtcacttggggatgggcctgcggcgcattagctagttggtggggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaggtgacggtacctgagaagaaagccccggctaactacgtgccagcagccgcggtaatacgtagggggcaagcgttgtccggaattattgggcgtaaagcgcgcgcaggcggtcatttaagtctggtgtttaatcccggggctcaaccccggatcgcactggaaactgggtgacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgagtgctaggtgttaggggtttcgatacccttggtgccgaagttaacaca

SEQ ID NO: 500 - DNA, 601 bp, Bacillus subtilis
  modified_base (210)..(210): a, c, t or g
cccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgtggttaataaccgcatngattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacg

SEQ ID NO: 501 - DNA, 602 bp, Bacillus subtilis
  modified_base (43)..(43): a, c, t or g
  modified_base (206)..(206): a, c, t or g
cttagggcgaccgatccctagctggtttgagaggatgaccagncccccctggaactgagacacgttccagactcatacgggaggcagcagtggggaatattgcacaatggggcgcaagcctgatgcagccatgccgcgtgtatgaagaaggccttcgggttgtaaagtactttcagcggggaggaaggcgatgtggttaataaccncatggattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacag

SEQ ID NO: 502 - DNA, 691 bp, Bacillus subtilis
  modified_base (66)..(66): a, c, t or g
ccggatagttccttgaaccgcatggtttcaaggatgaaagacggtttcggctgtcacttacagatngacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgcaagagtaactgcttgcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagt

SEQ ID NO: 503 - DNA, 746 bp, Bacillus subtilis
  modified_base (351)..(351): a, c, t or g
  modified_base (355)..(355): a, c, t or g
ttctgggatctgcccgatagagggggataaccactggaaaccggtggctaataccgcataacgtcgcaagaccaaagagggggaccttcgggcctctcactatcggatgaacccagatgggattagctagtaggcggggtaacggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgtggttaataaccncatngattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacg

SEQ ID NO: 504 - DNA, 606 bp, Bacillus pumilus
cccaccaaggcgacgatccgtagctggtctgagaggatgatcagccacactggaactgagacacggtccagactcctacgggaggcagcagtggggaatattggacaatgggcgcaagcctgatccagccatgccgcgtgggtgaagaaggccttcgggttgtaaagcccttttgttgggaaagaaaagcagtcggttaatacccgattgttctgacggtacccaaagaataagcaccggctaacttcgtgccagcagccgcggtaatacgaagggtgcaagcgttactcggaattactgggcgtaaagcgtgcgtaggtggttgtttaagtccgttgtgaaagccctgggctcaacctgggaattgcagtggatactgggcaactagagtgtggtagaggatggcggaattcccggtgtagcagtgaaatgcgtagagatcgggaggaacatctgtggcgaaggcggccatctggaccaacactgacactgaggcacgaaagcgtggggagcaaacaggattagataccctggtagtccacgccctaaacgatgcgaactggatgttgggtgcaacttggcacgcagtatcgaagctaacgcgta

SEQ ID NO: 505 - DNA, 705 bp, Micrococcus luteus
  modified_base (62)..(62): a, c, t or g
ccggagctaataccggatagttccttgaaccgcatggttcaaggatgaaagacggtttcggnctgtcacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgcaagagtaactgcttgcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagttc

SEQ ID NO: 506 - DNA, 780 bp, Sphingomonas yabuuchiae
gtggtggattagtggcgaaccggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctg

SEQ ID NO: 507 - DNA, 556 bp, Sphingomonas yabuuchiae
  modified_base (23)..(23): a, c, t or g
  modified_base (72)..(72): a, c, t or g
ccaaggcgacgatccgtagctgntgtgagaggatgatcagccacactggaactgagacacggtccagactcntacgggaggcagcagtggggaatattggacaatgggcgcaagcctgatccagccatgccgcgtgggtgaagaaggccttcgggttgtaaagcccttttgttgggaaagaaaagcagtcggttaatacccgattgttctgacggtacccaaagaataagcaccggctaacttcgtgccagcagccgcggtaatacgaagggtgcaagcgttactcggaattactgggcgtaaagcgtgcgtaggtggttgtttaagtccgttgtgaaagccctgggctcaacctgggaattgcagtggatactgggcaactagagtgtggtagaggatggcggaattcccggtgtagcagtgaaatgcgtagagatcgggaggaacatctgtggcgaaggcggccatctggaccaacactgacactgaggcacgaaagcgtggggagcaaacaggattagataccctggtagtccacgccctaaacgatgcgaac

SEQ ID NO: 508 - DNA, 649 bp, Acidovorax sp.
catggtttcaaggatgaaagacggtttcggctgtcacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgcaagagtaactgcttgcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgt

SEQ ID NO: 509 - DNA, 574 bp, Curtobacterium flaccumfaciens
  modified_base (39)..(39): a, c, t or g
ttcgggcttcgcgcggatagatgagccgatgtcggattngctagttggcggggtaaaggcccaccaaggcgacgatccgtagctggtctgagaggatgatcagccacactggaactgagacacggtccagactcctacgggaggcagcagtggggaatattggacaatgggcgcaagcctgatccagccatgccgcgtgggtgaagaaggccttcgggttgtaaagcccttttgttgggaaagaaaagcagtcggttaatacccgattgttctgacggtacccaaagaataagcaccggctaacttcgtgccagcagccgcggtaatacgaagggtgcaagcgttactcggaattactgggcgtaaagcgtgcgtaggtggttgtttaagtccgttgtgaaagccctgggctcaacctgggaattgcagtggatactgggcaactagagtgtggtagaggatggcggaattcccggtgtagcagtgaaatgcgtagagatcgggaggaacatctgtggcgaaggcggccatctggaccaacactgacactgaggcacgaaagcgtggggagcaa

SEQ ID NO: 510 - DNA, 1362 bp, Paenibacillus amylolyticus
accatgcagtcgaacgcatcgcaagatgagtggcagacgggtgagtaacgcgtgggaacatacccttttctacggaatagctctgggaaactggaattaataccgtatacgccctacgggggaaagatttatcggggaaggattggcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctctttcaccgatgaagataatgacggtagtcggagaagcagccccggctaacttcgtgccagcagccgcggtaatacgaagggggctagcgttgttcggaattactgggcgtaaagcgcacgtaggcggatatttaagtcaggggtgaaatcccagagctcaactctggaactgcctttgatactgggtatcttgagtatggaagaggtaagtggaattgcgagtgtagaggtgaaattcgtagatattcgcaggaacaccagtggcgaaggcggcttactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagctcttgacattcggggtatggtcattggagacgatgaccttcagttcggctggccctagaacaggtgctgcatggctgtcgtcagctcgtgtcgtgagatgttgggataagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagacagcgatgtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttttacccgaaggcgctgcgctaaccgcaagggggcaggcgaccacgt

SEQ ID NO: 511 - DNA, 1415 bp, Pantoea ananatis
acacatgcagtcgagcggatgagaggagcttgctcctcgattcagcggcggacgggtgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccctcgggtcgtaaagcactttaagttgggaggaagggctcatagcgaatacctgtgagttttgacgttaccaacagactaagcaccggctaacttcgtgccagcagccgcggtaatacgaagggtgcaagcgttaatcggaattactgggcgtaaagcgcgcgtaggtggcttgataagttgggatgtgaaatccccgggctcaacctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtggagcatgtggtttaattcgaagcaacgccttgatgcttacctggccttgacatgctgagaacctttcagagatggatacgtgccttcgggaactctcagactcgtgctgcatggctgtcgtcagctcgtgtcgtgagatgttgggttaagtcccgatacgagcgcaacggtactggtaagttaccagcacatcatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccctcgggaggacggtaccacga

SEQ ID NO: 512 - DNA, 1415 bp, Pantoea ananatis
acacatgcagtcgagcggatgagaggagcttgctcctcgattcagcggcggacgggtgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccctcgggtcgtaaagcactttaagttgggaggaagggctcatagcgaatacctgtgagttttgacgttaccaacagaataagcaccggctaacttcgtgccagcagccgcggtaatacgaagggtgcaagcgttaatcggaattactgggcgtaaagcgcgcgtaggtggcttgataagttggatgtgaaatccccgggctcaacctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacggggggcccgcacaagcggtggagcatggtggtttaattcgaagcaacgcgaagtaccttacctggccttgacatgctgagaaccttgcagagatggattggtgccttcgggaactcagacacaggtgctgcatggctgtcgtcagctcgtgtcgtgagatgttgggttaagtcccgtaacgagcgcaacccttgtccttagttaccagcacatcatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccctcgggaggacggtaccacg

SEQ ID NO: 513 - DNA, 1418 bp, Bacillus pumilus
acacatgcagtcgagcggatgagaggagcttgctcctcgattcagcggcggacgggtgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccctcgggtcgtaaagcactttaagttgggaggaagggctcatagcgaatacctgtgagttttgacgttaccaacagaataagcaccggctaacttcgtgccagcagccgcggtaatacgaagggtgcaagcgttaatcggaattactgggcgtaaagcgcgcgtaggtggcttgataagttggatgtgaaatccccgggctcaacctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtggagcatgtggtttaattcgaagcaacgcgaagatgcttacctggccttgacatgctgagaacattgcagagatggatatgtgccttcgggaactcagacacaggtgctgcatggctgtcgtcagctcgtgtcgtgagatgttgggttaagtcccgtaacgagcgcaacccttgtccttagttaccagcacatcatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccctcgggaggacggtaccacggagta

SEQ ID NO: 514 - DNA, 1401 bp, Pantoea ananatis
taccatgcagtcgaacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagcttacgcattaagcgccccgcctggggagtacggccgcaaggctaaaactcaaaggaattgacgggggcccgcacaagcggcggagcatgcggattaattcgatgcaacgcgaagaagcttaccaaggcttgacatacaccggaaacggccagagatggttggccccttgtggtcggtgtacaggtggtgcatggatgtcgtcagctcgtgtcgtgacatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagccgtcgaaagt

SEQ ID NO: 515 - DNA, 1407 bp, Xanthomonas translucens
catgcagtcgagcggatgagaggagcttgctcctcgattcagcggcggacgggtgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccctcgggtcgtaaagcactttaagttgggaggaagggctcatagcgaatacctgtgagttttgacgttaccaacagaataagcaccggctaacttcgtgccagcagccgcggtaatacgaagggtgcaagcgttaatcggaattactgggcgtaaagcgcgcgtaggtggcttgataagttggatgtgaaatccccgggctcaacctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtggagcatgtggtttaattcgaagcaacgcgttctagcttacctggccttgacatgctgagaacattgcagagatgctatgctgccttccgggactcagacacaggtgctgcatggctgtcgtcagctcgtgtcctgagatgatcggttaagtcccgtaacgagcgcaacccttgtccttagtatccagcacatcatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccctcgggaggacggtacc

SEQ ID NO: 516 - DNA, 1388 bp, Bacillus pumilus
ccatgcagtcgaacggcagcacagaatagcttgctctttgggtggcgagtggcggacgggtgagtaatgtctgggaaactgcccgatggagggggataactactggaaacggtagctaataccgcataacgtcgcaagaccagagtgggggaccttcgggcctcacgccatcggatgtgcccaaatgggattagctagtaggtggggtaatggctcacctaggcgacgatccctagctggtctgagaggatgaccagccacactggaactgagacacggtccatactcctacgggaggcggcaatggggaatattggacaatgggcgcaagcctgatgcacccatgccgcgtgtatgaagaaggccttcgggttgtaaagtactttcagcggggaggaaggcggtgaggttaataacctcgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaacgcggccccctggaccaacactgacgctcacgtgcgatagcgtggggagcaaacaggattacataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccagagaacttagcagagatgctttggtgccttcgggaactatgagacaggtgctgcatggccgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggta

SEQ ID NO: 517 - DNA, 1422 bp, Curtobacterium flaccumfaciens
accatgcagtcgaacggcagcacaggagagcttgctctctgggtggcgagtggcggacgggtgaggaatacatcggaatctaccttttcgtgggggataacgtagggaaacttacgctaataccgcatacgaccttagggtgaaagcggaggaccttcgggcttcgcgcggatagatgagccgatgtcggattagctagttggcggggtaaaggcccaccaaggcgacgatccgtagctggtctgagaggatgatcagccacactggaactgagacacggtccagactcctacgggaggcagcagtggggaatattggacaatgggcgcaagcctgatccagccatgccgcgtgggtgaagaaggccttcgggttgtaaagcccttttgttgggaaagaaaagcagtcggttaatacccgattgttctgacggtacccaaagaataagcaccggctaacttcgtgccagcagccgcggtaatacgaagggtgcaagcgttactcggaattactgggcgtaaagcgtgcgtaggtggttgtttaagtccgttgtgaaagccctgggctcaacctgggaattgcagtggatactgggcaactagagtgtggtagaggatggcggaattcccggtgtagcagtgaaatgcgtagagatcgggaggaacatctgtggcgaaggcggccatctggaccaacactgacactgaggcacgaaagcgtggggagcaaacaggattagataccctggtagtccacgccctaaacgatgcgaactggatgttgggtgcaacttggcacgcagtatcgaagctaacgcgttaagttcgccgcctggggagtacggtcgcaagactgaaactcaaaggaattgacgggggcccgcacaagcggtggagtatggtaggtttaattcgatgcaacgcgttctaccttacctggtcttgacatccacggaaccttgcagagatggattggtgcctttcggtagcgtgagacacgtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacgaccagggctacacacgtactacaatggtagggacagagggctgcaagccggcgacggtaagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgctgccacg

SEQ ID NO: 518 - DNA, 1358 bp, Xanthomonas translucens
aagcagtcgagcggacctttcggggtcagcggcggacgggtgagtaacgcgtgggaacgtgccttccggttcggaataaccctgggaaactagggctaataccggatacgcccttatggggaaaggtttactgccggaagatcggcccgcgtctgattagctagttggtggggtaacggcctaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctcttttatccgggacgataatgacggtaccggaggaataagccccggctaacttcgtgccagcagccgcggtaatacgaagggggctagcgttgctcggaatcactgggcgtaaagggcgcgtaggcggcgttttaagtcgggggttgaaagcctgtggctcaacccacagaatggcctttcgatactgggacgcttgagtatggtagaggttggtggaactgcgagtgtagaggtgaaattcgtagatattcgcaagaacaccggtggcgaaggcggccaactggaccattactgacgctgaggcgcgaaagcgtggggagcaaacaggattagataccctggtagtccacgccgtaaacgatgaatgccagctgttggggtgcttgcaccgcagtagcgcagctaacgctttgagcattccgcctggcgagtacggtcgcaagattaaaactcaaaggaattgacgggggcccgcacaagcggtggagcatgtggtttaattcgaagcaacgcgcagaaccttaccatcctttgacatggcgtgttacccagagagatttggggtccacttcggtggcgcgcacacaggtgctgcatggctgtcgtcagctcgtgtcgtgagatgttgggttaagtcccgcaacgagcgcaacccacgtccttagttgccatcattcagttgggcactctagggagactgccggtgataagccgcgaggaaggtgtggatgacgtcaagtcctcatggcccttacgggatgggctacacacgtgctacaatggcggtgacagtgggacgcgaaggagcgatctggagcaaatccccaaaagccgtctcagttcggattgcactctgcaactcgagtgcatgaaggcggaatcgctagtaatcgtggatcagcatgccacggtgaatacgttcccgggccttgtacacaccgcccgtcacaccatgggagttggtcttacccgacggcgctgcgccaaccgcaaggaggcaggcgtccac

SEQ ID NO: 519 - DNA, 1422 bp, Bacillus pumilus
catgcagtcgaacggcagcacagcagagcttgctctgtgggtggcgagtggcggacgggtgagtaatgcatcgggacctacccagacgtgggggataacgtagggaaacttacgctaataccgcatacgtcctacgggagaaagcgggggatcgcaagacctcgcgcggttggatggaccgatgtgcgattagctagttggtgaggtaatggctcaccaaggcgacgatcgctagctggtctgagaggatgatcagccacactgggactgagacacggcccagactcctacgggaggcagcagtggggaatattggacaatgggcgcaagcctgatccagcaatgccgcgtgtgtgaagaaggccctcgggttgtaaagcacttttatcaggagcgaaatctgcaaggttaatacctttgcagtctgacggtacctgaggaataagcaccggctaactccgtgccagcagccggcggtaatacggaggggtgcaagcgttaatcggaattactgggcgtaaagcgtgcgtaggcggttcgttaagtctgctgtgaaagccccgggctcaacctgggaatggcagtggatactggcgagctagagtgtgatagaggatggtggaattcccggtgtagcggtgaaatgcgtagagatcgggaggaacatcagtggcgaaggcggccatctggatcaacactgacgctgaggcacgaaagcgtggggagcaaacaggattagataccctggtagtccacgccctaaacgatgcgaactggatgttggtctcaactcggagatcagtgtcgaagctaacgcgttaagttcgccgcctggggagtacggtcgcaagactgaaactcaaaggaattgacgggggcccgcacaagcggtgggagtatgtggtttaattcgatgcaacgcgaagaaccttacctgggcatgacatgtccggaatcctgcagagatgcgggagtgccttcgggaatcggaacacagctgctgcatggctgtcgtcagctcgtgtcgtgagatgttgggttaagtcccgcaacgagcgcaacccttgtccttagttgccagcgagtaatgtcgggaactctaaggagactgccggtgacaaaccggaggaaggtggggatgacgtcaagtcatcatggcccttacggccagggctacacacgtactacaatggtcggtacagagggttgcgataccgcgaggtggagctaatcccagaaagccgatcccagtccggattggagtctgcaactcgactccatgaagtcggaatcgctagtaatcgcagatcagctatgctgcggtgaatacgttcccgggccttgtacacaccgcccgtcacaccatgggagtgagctgctccagaagccgttagtctaaccgcaagggggacgacgaccacg

SEQ ID NO: 520 - DNA, 1356 bp, Xanthomonas translucens
catgcagtcgaacgcatcgcagatgagtggcagacgggtgagtaacgcgtgggaacatacccttttctacggaatagctctgggaaactggaattaataccgtatacgccctacgggggaaagatttatcggggaaggattggcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctctttcaccgatgaagataatgacggtagtcggagaagaagccccggctaacttcgtgccagcagccgcggtaatacgaagggggctagcgttgttcagaattactgggcgtaaagcgcacgtaggcggatatttaagtcaggggtgaaatcccagagctcaactctggaactgcctttgatactgggtatcttgagtatggaagaggtaagtggaattgcgagtgtagaggtgaaattcgtagatattcgcaggaacaccagtggcgaaggcggcttactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagctcttgacattcggggtatggtcattgggagacgatgaccttcagttcggctggccctagaacaggtgctgcatggctgtcgtcagctcgtgtcgtgagatgttgggataagtcccgcaacgagcgcaaccctcccgcatagttggcagcatttagttgggctctctatcgggactgccggtgatatccgcagaggaaggtggggatgacgtcaagtcctcatggcccttacgggctgggctacacacgtgctacaatggtggtgacagtgggcagcgagacagcgatgtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttttacccgaaggcgctgcgctaaccgcaagggggcaggcgacc

SEQ ID NO: 521 - DNA, 1420 bp, Agrobacterium sp.
cacatgcagtcgaacggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataacctcgccgattgacgttacccgcagaagaagcaccggctaactccgtgccagcagccgcggtaatacggagggtgcaagcgttaatcggaattactgggcggtaaagcgcacgcaggcggtctgttaagtcagatgtgaaatccccgggcttaacctgggaactgcatttgaaactggcaggcttgagtctcgtagaggggggtagaattcccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagtagcttacctggccttgacatccagagaacatagcagagatgctttggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccactt

SEQ ID NO: 522 - DNA, 1348 bp, Pseudomonas sp.
aacgaaggcttcggccttagtggcgcacgggtgcgtaacgcgtgggaatctgccctttggttcggaataacagctggaaacggctgctaataccggatgatgacgaaagtccaaagatttatcgccagaggatgagcccgcgttggattaggtagttggtggggtaaaggcctaccaagccgacgatccatagctggtctgagaggatgatcagccacactgggactgagacacggcccagactcctacgggaggcagcagtggggaatattggacaatgggcgaaagcctgatccagcaatgccgcgtgagtgatgaaggccctagggttgtaaagctcttttacccgggaagataatgactgtaccgggagaataagccccggctaactccgtgccagcagccgcggtaatacggagggggctagcgttgttcggaattactgggcgtaaagcgcacgtaggcggctttgtaagtcagaggtgaaagcctggagctcaactccagaactgcctttgagactgcatcgcttgaatccaggagaggtcagtggaattccgagtgtagaggtgaaattcgtagatattcggaagaacaccagtggcgaaggcggctgactggactggtattgacgctgaggtgcgaaagcgtggggagcaaacaggattagataccctggtagtccacgccgtaaacgatgataactagctgtccgggcacttggtgcttgggtggcgcagctaacgcattaagttatccgcctggggagtacggccgcaaggttaaaactcaaaggaattgacgggggcctgcacaagcggtggagcatgtggtttaattcgaagcaacgcgcagaaccttaccagcgtttgacatgtccggacgatttccagagatggatctcttcccttcggggactggaacacaggtgctgcatggctgtcgtcagctcgtgtcgtgagatgttgggttaagtcccgcaacgagcgcaaccctcgcctttagttaccatcatttagttgggtactctaaaggaaccgccggtgataagccggaggaaggtggggatgacgtcaagtcctcatggcccttacgcgctgggctacacacgtgctacaatggcaactacagtgggcagcgaccctgcgagggcgagctaatccccaaaagttgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgttgcgccaacccgcaagggaagcaggcgtac

SEQ ID NO: 523 - DNA, 1419 bp, Pseudomonas sp.
cacatgcagtcgaacggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataaccttgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagatgcttacctggccttgacatccagagaacatagcagagatgctttggtgccttgcggtactctgagacaggtgctgcatggctgtcgtcagctcgtgttgactaatgttgggttaagtcccgcatgctgcgcaacccttatcctttgttgccagcggctcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccactta

SEQ ID NO: 524 - DNA, 1424 bp, Pseudomonas sp.
gctacacatgcagtcgaacggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataaacttgccgattgacgttacccgcagaagaagcaccggctaactccgtgccagcagccgcattaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccagagaacttagcagagatgctttggtgccttcgggaactctgagacaggtgctgcatggctgtcgtcagctcgtgttgtgaatagtagggttaagtcccggtacgagcgcaagccttatcctttgttgccagcggctcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccacttgg

SEQ ID NO: 525 - DNA, 1422 bp, Curtobacterium sp.
acacatgcagtcgaacggcagcacaggagagcttgctctctgggtggcgagtggcggacgggtgaggaatacatcggaatctaccttttcgtgggggataacgtagggaaacttacgctaataccgcatacgaccttagggtgaaagcggaggaccttcgggcttcgcgcggatagatgagccgatgtcggattagctagttggcggggtaaaggcccaccaaggcgacgatccgtagctggtctgagaggatgatcagccacactggaactgagacacggtccagactcctacgggaggcagcagtggggaatattggacaatgggcgcaagcctgatccagccatgccgcgtgggtgaagaaggccttcgggttgtaaagcccttttgttgggaaagaaaagcagtcggttaatacccgattgttctgacggtacccaaagaataagcaccggctaacttcgtgccagcagccgcggtaatacgaagggtgcaagcgctactcggaattactgggcgtaaagcgtgcgtaggtggttgtttaagtccgttgtgaaagccctgggctcaacctgggaattgcagtggatactgggcaactagagtgtggtagaggatggcggaattcccggtgtagcagtgaaatgcgtagagatcgggaggaacatctgtggcgaaggcggccatctggaccaacactgacactgaggcacgaaagcgtggggagcaaacaggattagataccctggtagtccacgccctaaacgatgcgaactggatgttgggtgcaacttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggtcttgacatccacggaacattgcagagatggattggtgccttcgggaaccgtgagacaggtgctgcatggctgtcgtcagctcgtgtcctgtcatgttcggttaagtcccgcaacgagcgcaacccttgtccttagttgccagcacgtaatggtgggaactctaaggagaccgccggtgacaaaccggaggaaggtggggatgacgtcaagtcatcatggcccttacgaccagggctacacacgtactacaatggtagggacagagggctgcaagccggcgacggtaagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgctgccacgg

SEQ ID NO: 526 - DNA, 1421 bp, Pseudomonas sp.
accatgcagtcgaacggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataacttctccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccagagaacttagcagagatgctttggtgccttcgggaactctgagacaggtgctgcatggctgtcgtcagctcgtgatgtgaaatgttgggttaagtcccgcaacgagcgcaacccttatcctttgttgccagcggctcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccacttgat

SEQ ID NO: 527 - DNA, 1420 bp, Erwinia sp.
accatgcagtcgaacggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataaccttgtcgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatggtggtttaattcgatgcaacgcgaagtagcttacctggccttgacatccagagaacttagcagagatgctttggtcgcttcgggaactctgacacaggtgctgcatggctgtcgtcagctcgtgttgtgaaatgttgggttaagtcccgcaacgagcgcaacccttatcctttgttgccagcggctcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccacttt

SEQ ID NO: 528 - DNA, 1422 bp, Xanthomonas sp.
tacacatgcagtcgaacggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataaccttgtcgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaaccctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacggggggcccgcacaagcggtggagcatgtggtttaattcgatgcaacgcgaagaaccttacctggccttgacatccagagaacttagcagagatgctttggtcgcttcgggaactctgagacaggtgctgcatggctgtcgtcagctcgtgtagtgaaatgttgggttaagtcccgcaacgagcgcaacccttatcctttgttgccagcggctcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccacat

SEQ ID NO: 529 - DNA, 1421 bp, Methylobacterium sp.
ctacacatgcagtcgaacggtaacaggaagcagcttgctgcttcgctgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgtggttaataaccgcgtcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcatccgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacagaactttgcagagatgcattggtgccttcgggaactgtgagacaggtgctgcatggctgtcgtcagctcgtgttgtgaaatgttgggttaagtcccgcaacgagcgcaacccttatcctttgttgccagcggtcaggccgggaactcaaaggagactgccagtgataaactggaggaaggtggggatgacgtcaagtcatcatggcccttacgaccagggctacacacgtgctacaatggcgcatacaaagagaagcaatctcgcgagagctagcggacctcataaagtgcgtcgtagtccggattggagtctgcaactcgactccatgaagtcggaatcgctagtaatcgtgaatcagaatgtcacggtgaatacgttcccgggccttgtacacaccgcccgtcacaccatgggagtgggttgcaaaagaagtaggtagcttaaccttcgggagggcgctaccactt

SEQ ID NO: 530 - DNA, 1424 bp, Luteibacter sp.
tacacatgcagtcgaacggtagcacagagagcttgctctcgggtgacgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtggagttaataccttcaccgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggcttaacctgggaactgcattcgaaactggcaggctggagtcttgtagaggggggtagaattccaggtgtagcggtgaaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacggggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttga

SEQ ID NO: 531 - DNA, 1428 bp, Agrobacterium sp.
tgctatacatgcagtcgagcggacagatgggagcttgctccctgatgttagcggcggacgggtgagtaacacgtgggtaacctgcctgtaagactgggataactccgggaaaccggggctaataccggatggttgtttgaaccgcatggttcaaacataaaaggtggcttcggctaccacttacagatggacccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagtagcttaccaggtcttgacatcctctgacaatcctagagataggacgtccccttcgggggcagagtgacaggtcgtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccg

SEQ ID NO: 532 - DNA, 1403 bp, Pantoea sp.
accatgcaagtcgaacgatgaagcccagcttgctgggtggattagtggcgaacgggtgagtaacacgtgagcaacctgcccctgactctgggataagcgctggaaacggtgtctaatactggatatgtcccatcaccgcatggtgtgtgggtggaaagatttttcggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggatgacggccttcgggttgtaaacctcttttagcagggaagaagcgagagtgacggtacctgcagaaaaagcaccggctaactacgtgccagcagccgcggtaatacgtagggtgcaagcgttatccggaattattgggcgtaaagagctcgtaggcggtttgtcgcgtctgctgtgaaattccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtgggggagcaaacaggcttagataccctggtagtccaccccgtaaacgttgggaactagttgtggggtcctttccacggattccgtgacgcagctaacgcattaagttccccgcctggggagtacggccgcaaggctaatactcaaaggaattgacggggacccgcacaagcggcggagcatgcggattaattcgatgcaacgcgaagaaccttaccaaggcttgacatacacgagaacgggccagaaatggtcaactctttcgacactcgtgaacagcaggtgcatggttgtcgtcagctcgtgtcgtggacaagttgggttatgtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaatgggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcctaacccttgtggagggagccgtcgaagg

SEQ ID NO: 533 - DNA, 1420 bp, Sphingomonas sp.
acacatgcagtcgaacggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggctgtgaggttaataaccttgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacggggggcccgcacaagcggtggagcatgtggtttaattcgatgcaacgcgaagaaccttacctggccttgacatccagagaacttagcagagatgctttggtgccttcgggaactctgagacaggtgctgcatggctgtcgtcagctcgtgttgtgaaatgatgggataagtcccgcaacgagcgcaacccttatcctttgttgccagcggctcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccactg

SEQ ID NO: 534 - DNA, 1421 bp, Pantoea sp.
acatgcagtcgagcggtagcacaggagagcttgctctccgggtgacgagcggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgttgaggttaataacctcgtcaattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcacgtgcgaaagcgtggggagcaaacaggattagataccctggtagtccacgccgtatacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatggtggtttaattcgatgcaacgcgaagaaccttacctactcttgacatccagagaactttgcagagatgcattggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccactttga

SEQ ID NO: 535 - DNA, 1420 bp, Pantoea sp.
accatgcagtcgaacggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataaccttgtcgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccagagtacttagcagagatgctttggtgccttcgggaactctgagacaggtgctgcatggctgtcgtcagctcgtgttgacaaatgttgggttaagtcccgcaacgagcgcaacccttatcctttgttgccagcggctcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccactttg

SEQ ID NO: 536 - DNA, 1418 bp, Xanthomonas sp.
catgcagtcgaacggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataaccttgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacgggccgcaaggttaaaactcaaatgaattgacggggggcccgcacaagcggtggagcatgtggtttaattcgatgcaacgcgaagaaccttacctggccttgacatccagagaacttagcagagatgctttggtgccttcgggaactctgagacaggtgctgcatggctgtcgtcagctcgtgttcacaaatgttgggttaagtcccgcaacgagcgcaacccttatcctttgttgccagcggctcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccacct

SEQ ID NO: 537 - DNA, 1422 bp, Pantoea sp.
taccatgcagtcgagcggtagcacaggagagcttgctctccgggtgacgagcggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgttgaggttaataacctcgtcaattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtaccgccgcaaggttaaaactcaaatgaattgacgggggcccgcacaagcggtggagcatgtggtttaattcgatgcaacgcgaagtaccttacctactcttgacatccagagtacttttcagagatgcattggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccactttga

SEQ ID NO: 538 - DNA, 1375 bp, Pantoea sp.
acgatgaagcggtgcttgcaccgtggattagtggcgaacgggtgagtaacacgtgagcaacctgccctggactctgggataagcgctggaaacggtgtctaatactggatatgagctctcatcgcatggtgggggttggaaagattttttggtctgggatgggctcgcggcctatcagcttgttggtgaggtaatggcttaccaaggcgtcgacgggtagccggcctgagagggtgaccggccacactgggactgagacacggcccagactcctacgggaggcagcagtggggaatattgcacaatgggcggaagcctgatgcagcaacgccgcgtgagggatgacggccttcgggttgtaaacctcttttagcagggaagaagcgtgagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatcccgaggctcaacctcgggtctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtagacgttgggaaactagttgtggggaccattccacggtttccgtgacgcagctaacgcattaagttccccgcctgggggagtacggccgcaaggctaaaactcaaaaggcaattgacggggacccgcacaagcggcggagcatgcggattaattcgatgcaacgcgaagaaccttaccaaggcttgacatacaccagaacaccgtagaaatacgggactctttggacactggtgaacaggtggtgcatggttgtcgtcagctcgtgtcgtgagatgttgggttaagtcccgcaacgagcgcaaccctcgttctatgttgccagcacgttatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcccaacccttgtgga

SEQ ID NO: 539 - DNA, 1419 bp, Pantoea sp.
cacatgcagtcgaacggtaacaggaagcagcttgctgctttgctgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgcggttaataaccgcgtcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcatccgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaagcttacctggtcttgacatccacagaacttggcagagatgccttggtgccttcgggaactgtgagaacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcaatctcgcgagagctagcggacctcataaagtgcgtcgtagtccggattggagtctgcaactcgactccatgaagtcggaatcgctagtaatcgtgaatcagaatgtcacggtgaatacgttcccgggccttgtacacaccgcccgtcacaccatgggagtgggttgcaaaagaagtaggtagcttaaccttcgggagggcgctaccacat

SEQ ID NO: 540 - DNA, 1415 bp, Enterobacter sp.
catgcagtcgaacggtaacaggaagcagcttgctgctttgctgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgcggttaataaccgcgtcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcatccgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacagtacttggcagacatgccttggtgccttcgggaactgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcaatctcgcgagagctagcggacctcataaagtgcgtcgtagtccggattggagtctgcaactcgactccatgaagtcggaatcgctagtaatcgtgaatcagaatgtcacggtgaatacgttcccgggccttgtacacaccgcccgtcacaccatgggagtgggttgcaaaagaagtaggtagcttaaccttcgggagggcgctaccata

SEQ ID NO: 541 - DNA, 1419 bp, Enterobacter sp.
tgacagtcgacggtaacaggaagcagcttgctgctttgctgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgcggttaataaccgcgtcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcatccgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatggtggtttaattcgatgcaacgcgaagaaacgttacctggtcttgacatccacagaactttggcagagatgccttggtgccttccggaactgtgacacacgtgctgcatggctgtcgtcagcctcgagttgagaaatggttagggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcaatctcgcgagagctagcggacctcataaagtgcgtcgtagtccggattggagtctgcaactcgactccatgaagtcggaatcgctagtaatcgtgaatcagaatgtcacggtgaatacgttcccgggccttgtacacaccgcccgtcacaccatgggagtgggttgcaaaagaagtaggtagcttaaccttcgggagggcgctaccatc

SEQ ID NO: 542 - DNA, 1420 bp, Bacillus sp.
acacatgcagtcgaacggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataaccttgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccagacaacttagcacagatgctttggtgccttcgggaactctgagacaggtgctgcatggctgtcgtcagctcgtgttgtgaaatgttgggttaagtcccgcaacgagcgcaacccttatcctttgttgccagcggctcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccacttg

SEQ ID NO: 543 - DNA, 1410 bp, Bacillus sp.
gacagtcgaacggcagcacagaagaagcttgctctattgggtggcgagtggcggacggtggagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataacctcgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacggggggcccgacaagcggtggagcatgtggtttaattcgatgcaacgcgaagaaccttacctggccttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggctcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcataaagaagtagttagcttaaccttcgggagggctc

SEQ ID NO: 544 - DNA, 1409 bp, Pantoea sp.
acagcagtcgacggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataaccttgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacggggccccgcacaagccgtggagcatgtggtttaattcgatgcaacgcgaagaaccttacctggccttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggctcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcta

SEQ ID NO: 545 - DNA, 1417 bp, Enterobacter sp.
cagtcgagcgacagacgaggagcttgctcctctgacgttagcggcggacgggttagtaacacgtggataacctacctataagactgggataacttcgggaaaccggagctaataccggataacatgttgaaccgcatggttcaacagtgaaagacggtcttgctgtcacttatagatggatccgcgccgcattagctagttggtaaggtaacggcttaccaaggcaacgatgcgtagccgacctgagagggtgatcggccacactggaactgagacacggtccagactcctacgggaggcagcagtagggaatcttccgcaatgggcgaaagcctgacggagcaacgccgcgtgagtgaagaaggtcttcggatcgtaaaactctgttattagggaagaacaaatgtgtaagtaactatgcacgtcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattcccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctctgacccctctagagatagagttttccccttcgggggacagagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacaatacaaagggtagcgaaaccgcgaggtcaagcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccgtgtggagtaacctttggagctagcctac

SEQ ID NO: 546 - DNA, 1416 bp, Pantoea sp.
acatgcaagtcgagcggatgagaggagcttgctcctcgattcagcggcggacgggtgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccttcgggtcgtaaagcactttaagttgggaggaagggcttacagcgaatacctgtgagttttgacgttaccgacagaataagcaccggctaacttcgtgccagcagccgcggtaatacgaagggtgcaagcgttaatcggaattactgggcgtaaagcgcgcgtaggtggcttgataagttggatgtgaaatcccccgggctcaacctgggaactgcatccaaaactgtctggctagagtgtggtagagggtagtggaatttcccagtgtagcggtgaaatgcgtagatattggaaggaacaccagtggcgaaggcgactacctggactaacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggtttagtcccgtaacgagcgcaacccttgtccttagttaccagcacattatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccctcgggaggacggtaccacgga

SEQ ID NO: 547 - DNA, 1367 bp, Pantoea sp.
acatgcagtcgaacgaaggcttcggccttagtggcgcacgggtgcgtaacgcgtgggaatctgcccttaggttcggaataacagctggaaacggctgctaataccggatgatatcgcgagatcaaagatttatcgcctgaggatgagcccgcgttggattaggtagttggtggggtaaaggcctaccaagccgacgatccatagctggtctgagaggatgatcagccacactgggactgagacacggcccagactcctacgggaggcagcagtggggaatattggacaatgggcgcaagcctgatccagcaatgccgcgtgagtgatgaaggccctagggttgtaaagctcttttacccgggaagataatgactgtaccgggagaataagccccggctaactccgtgccagcagccgcggtaatacggagggggctagcgttgttcggaattactgggcgtaaagcgcacgtaggcggctttgtaagtcagaggtgaaagcctggagctcaactccagaactgccctttgagactgcatcgcttgaatccaggagaggtcagtggaattccgagtgtagaggtgaaattcgtagatattcggaagaacaccagtggcgaaggcggctgactggactggtattgacgctgaggtgcgaaagcgtggggagcaaacaggattagataccctggtagtccacgccgtaaacgatgataactagctgtccgggcacttggtgcttgggtggcgcagctaacgcattaagttatccgcctggggagtacggccgcaaggttaaaactcaaaggaattgacgggggcctgcacaagcggtggagcatgtggtttaattcgaagcaacgcgcagaaccttaccagcgtttgacatgtccggacgatttccagagatggattttcttcccttcggggactgggaacacaggtgctgcatggctgtcgtcagctcgtgtcgtgagatgttgggttaagtcccgcaacgagcgcaaccctcgcctttagttaccatcatttggttgggtactctaaaggaaccgccggtgataagccggaggaaggtggggatgacgtcaagtcctcatggcccttacgcgctgggctacacacgtgctacaatggcaactacagtgggcagcgaccctgcgagggcgagctaatccccaaaagttgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgttgcgccaacccgcaagggaagcaggcgaccacggt

SEQ ID NO: 548 - DNA, 1390 bp, Enterobacter sp.
cagcagtcgaacggtggagccaagcttgcttggtggatcagtggcgaacgggtgagtaacacgtgagcaacctgccctggactctgggataagcgctggaaacggcgtctaatactggatatgagacgtgatcgcatggtcgtgtttggaaagatttttcggtctgggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcggaagcctgatgcagcaacgccgcgtgagggatgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatcccgaggctcaacctcgggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggaccattccacggtttccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtaaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcccaacccttgtggagggagccta

SEQ ID NO: 549 - DNA, 1423 bp, Microbacterium sp.
cacatgcaagtcgaacggcagcacagaggagcttgctccttgggtggcgagtggcggacgggtgaggaatacatcggaatctactttttcgtgggggataacgtagggaaacttacgctaataccgcatacgacctacgggtgaaagcaggggatcttcggaccttgcgcgattgaatgagccgatgtcggattagctagttggcggggtaaaggcccaccaaggcgacgatccgtagctggtctgagaggatgatcagccacactggaactgagacacggtccagactcctacgggaggcagcagtggggaatattggacaatgggcgcaagcctgatccagccataccgcgtgggtgaagaaggccttcgggttgtaaagcccttttgttgggaaagaaatccagccggctaatacctggttgggatgacggtacccaaagaataagcaccggctaacttcgtgccagcagccgcggtaatacgaagggtgcaagcgttactcggaattactgggcgtaaagcgtgcgtaggtggttgtttaagtctgttgtgaaagccctgggctcaacctgggaactgcagtggaaactggacaactagagtgtggtagagggtagcggaattcccggtgtagcagtgaaatgcgtagagatcgggaggaacatccatggcgaaggcagctaccctggaccaacactgacactgaggcacgaaagcgtggggagcaaacaggattagataccctggtagtccacgccctaaacgatgcgaactggatgttgggtgcaatttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaagcttacctggccttgacatgtcgagaactttccagagatggattggtgccttcgggaactcgaacacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacggccagggctacacacgtactacaatggtagggacagagggctgcaagccggcgacggtaagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgctgccacgg

SEQ ID NO: 550 - DNA, 1333 bp, Enterobacter sp.
gagagccttcggagtttagtggcgcacgggtgcgtaacgcgtgggaatctgccctttggttcggaataacagctggaaacggctgctaataccggatgatgacgaaagtccaaagatttatcgccagaggatgagcccgcgttggattaggtagttggtggggtaaaggcctaccaagccgacgatccatagctggtctgagaggatgatcagccacactgggactgagacacggcccagactcctacgggaggcagcagtggggaatattggacaatgggcgaaagcctgatccagcaatgccgcgtgagtgatgaaggccctagggttgtaaagctcttttacccgggaagataatgactgtaccgggagaataagccccggctaactccgtgccagcagccgcggtaatacggagggggctagcgttgttcggaattactgggcgtaaagcgcacgtaggcggctttgtaagtcagaggtgaaagcctggagctcaactccagaactgcctttgagactgcatcgcttgaatccaggagaggtcagtggaattccgagtgtagaggtgaaattcgtagatattcggaagaacaccagtggcgaaggcggctgactggactggtattgacgctgaggtgcgaaagcgtggggagcaaacaggattagataccctggtagtccacgccgtaaacgatgataactagctgtccgggcacttggtgctttgggtggcgcagctaacgcacttaagttatccgcctggggagtacggccgcaaggttaaaactcaaaggaattgacgggggcctgcacaagcggtggagcatgtggtttaattcgaagcaacgcgcagaaccttaccagcgtttgacatgtccggacgatttccagagatggatctcttcccttcggggactggaacacaggtgctgcatggctgtcgtcagctcgtgtcgtgagatgttgggttaagtcccgcaacgagcgcaaccctcgcctttagttaccatcatttggttgggtactctaaaggaaccgccggtgataagccggaggaaggtggggatgacgtcaagtcctcatggcccttacgcgctgggctacacacgtgctacaatggcaactacagtgggcagcgaccctgcgagggcgagctaatccccaaaagttgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgttgctgacgcagatc

SEQ ID NO: 551 - DNA, 1405 bp, Enterobacter sp.
tgcagtcgagcggatgagaggagcttgctcctcgattcagcggcggacgggtgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccttcgggtcgtaaagcactttaagttgggaggaagggcttacagcgaatacctgtgagttttgacgttaccgacagaataagcaccggctaacttcgtgccagcagccgcggtaatacgaagggtgcaagcgttaatcggaattactgggcgtaaagcgcgcgtaggtggcttgataagttggatgtgaaatccccgggctcaacctgggaactgcatccaaaactgtctggctagagtgtggtagagggtagtggaatttccagtgtagcggtgaaatgcgtagatattggaaggaacaccagtggcgaaggcgactacctggactaacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtggagcatgtgggtttaattcgaagcaacgcgaagaagcttacctgggcttgacatgctgagaactttccagagatggattggtgccttcgggaactcagacacctggtgctgcatggctgtcgtcagctcgtgtcgtgagatgttgggttaagtcccgtaacgagcgcaacccttgtccttagttaccagcacattatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccctcgggaggacggta

SEQ ID NO: 552 - DNA, 1412 bp, Enterobacter sp.
catgcagtcgagcggatgagaggagcttgctcctcgattcagcggcggacgggtgagtaatgcctaggaatctgcccagtagtgggggacaacgtttcgaaaggaacgctaataccgcatacgtcctacgggagaaagtgggggatcttcggacctcacgctattggatgagcctaggtcggattagctagttggtggggtaacggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccctcgggtcgtaaagcactttaagttgggaggaagggcttacagcgaaatacctgtgagttttgacgttaccaacagaataaagcaccggctaacttcgtgccagcagccgcggtaatacgaagggtgcaagcgttaatcggaattactgggcgtaaagcgcgcgtaggtggcttgataagttggatgtgaaatccccgggctcaacctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtggagcatgtggattaattcgaagcaacgcgaagaaaccttacctggccatgacttgctgagaactttccagaacatggattggtgccttcgggtactcagacacaggtgctgcatggctgtcgtcagctcgtgtcgtgagatgttgggttaagtcccgtaacgagcgcaacccttgtccttagttaccagcacgtcatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccttcggggggacggtacca

SEQ ID NO: 553 - DNA, 1388 bp, Pantoea sp.
gtagcagtcgtgcgggtgtaagacgcgatgattgctcctcgattcagcggcggacgggtgagtaatggctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccttcgggtcgtaaagcactttaagttgggaggaagggcttacagcgaatacctgtgagttttgacgttaccgacagaataagcaccggctaacttcgtgccagcagccgcggtaatacgaagggtgcaagcgttaatcggaattactgggcgtaaagcgcgcgtaggtggcttgataagttggatgtgaaatccccgggctcaacctgggaactgcatccaaaactgtctggctagagtgtggtagagggtagtggaatttccagtgtagcggtgaaatgcgtagatattggaaggaacaccagtggcgaaggcgactacctggactaacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtgggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagtag

SEQ ID NO: 554 - DNA, 1422 bp, Pantoea sp.
atgcagtcgagcggacttaaaaagcttgctttttaagttagcggcggacgggtgagtaacacgtgggcaacctgcctgtaagactgggataacttcgggaaaccggagctaataccggataatccttttctactcatgtagaaaagctgaaagacggtttacgctgtcacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtacgagagtaactgctcgtaccttgacggtacctaacccagaaagccacgggctaactacgtgccagcagccgcggtaatacgtaggtggcaagcgttgtccggaattattgggcgtaaagcgcgcgcaggcggtcctttaagtctgatgtgaaagcccacggctcaacccgtggagggtcattggaaactgggggacttgagtgcagaagagaagagtggaatttccacgtgtagcggtgaaatgcgtagagatgtggaggaacaccagtggcgaaggcgactctttggtctgtaactgacgctgaggcgcgaaagcgtggggagcaaacaggattagataccctggtagtccacgccgtaaacgatgagtgctaagtgttagagggtttccgccctttagtgctgcagcaaacgcattaagcactccgcctggggagtacggccgcaaggctgaaactcaaaggaattgacgggggcccgcacaagcggtggagcatgtggtttaattcgaagcaacgcgaagaaccttaccaggtcttgacatctcctgacaatcctagagataggacgttccccttcgggggacaggatgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatggtacaaagggcagcaaaaccgcgaggtcgagccaatcccataaaaccattctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtgtgggtaacccttctgggagccagcct

SEQ ID NO: 555 - DNA, 1422 bp, Pantoea sp.
catgcaagtcgagcggacagaagggagcttgctcccggatgttagcggcggacgggtgagtaacacgtgggtaacctgcctgtaagactgggataactccgggaaaccggagctaataccggatagttccttgaaccgcatggttcaaggatgaaagacggtttcggctgtcacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgcaagagtaactgcttgcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaaggaattgacgggggcccgcacaagcggtggagcatgtggtttaattcgaagcaacgcgaagaaccttaccaggtcttgacatcctctgacaaccctagagatagggctttcccttcggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggctgcgagaccgcaaggtttagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgcaacacccgaagtcggtgaggtaacctttatggagccagcctccg

SEQ ID NO: 556 - DNA, 1432 bp, Staphylococcus sp.
atacatgcagtcgagcggacagaagggagcttgctcccggatgttagcggcggacgggtgagtaacacgtgggtaacctgcctgtaagactgggataactccgggaaaccggagctaataccggatagttccttgaaccgcatggttcaaggatgaaagacggtttcggctgtcacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgcaagagtaactgcttgcaccttgaccggtacctaaccagaaaaggccacggctaactacgtgccagcagccgcggtaatacgtaggtggcaagcgttgtccggaattattgggcgtaaagggctcgcaggcggtttcttaagtctgatgtgaaagcccccggctcaacccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggattaattcgaagcaacgcgaagaagcttaccaggtcttgacatcctctgacaaccctagagatagggctttcccttcggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggctgcgagaccgcaaggtttagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgcaacacccgaagtcggtgaggtaacctttatggagccagccgccgaaggt

SEQ ID NO: 557 - DNA, 1416 bp, Pseudomonas sp.
cacatgcagtcgaacggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataaccttgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattcccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaagcttacctggccttgacatccagagaacttagcagagatgctttggtgccttcgggaacttctgagacaggtgctgcatggctgtcgtcagctcgtgttgtgaaatgttgggttaagtcccgcaacgagcgcaacccttatcctttgttgccagcggctcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttac

SEQ ID NO: 558 - DNA, 1409 bp, Sphingomonas sp.
cgaacggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataaccttgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccagagaaacttagcagagatgctttggtgccttcgggaactctgagacaggtgctgcatggctgtcgtcagctcgtgttgtgaaatgttgggttaagtcccgcaacgagcgcaacccttatcctttgttgccagcggctcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccact

SEQ ID NO: 559 - DNA, 1409 bp, Microbacterium sp.
agtcgacggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataaccttgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggctcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccatc

SEQ ID NO: 560 - DNA, 1419 bp, Stenotrophomonas sp.
ctaccatgcagtcgacggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataaccttgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctgggcttgacttccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggctcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccacga

SEQ ID NO: 561 - DNA, 1416 bp, Sphingomonas sp.
acacatgcagtcgacggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataaccttgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaaccctgggaactgcatttgaaactggcaggcttgagtctcgtagaggggggtagaattcccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggcgagtacggccgcaaggttaaaactcaaatgaattgacgggggccccgcacaagcggtggagcatgtggtttaattcgatgcaacgcgaagaaccttacctgggccttgacatccagactagatagcagacatgctttggtgccttcgggaactctgagacaggtgctgcatggctgtcgtcagctcgtgttgtgaaatgttgggttaagtcccgcaacgagcgcaacccttatcctttgttgccagcggctcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctt

SEQ ID NO: 562 - DNA, 1414 bp, Pseudomonas sp.
atgcagtcgacggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataaccttgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggaggagcatgtggtttaattcgatgcaacgcgaagaaccttacctgggccttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggctcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtagtgtagcttaaccttcgggagggcgctaccag

SEQ ID NO: 563 - DNA, 1417 bp, Pseudomonas sp.
catgcagtcgacggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataaccttgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacgggccgcaaggttaaaactcaaatgaattgacgggggcccgcacaagcggtggagcatgtggtttaattcgatgcaacgcgaagaaccttacctggccttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggctcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccacttc

SEQ ID NO: 564 - DNA, 1384 bp, Pseudomonas sp.
agccgagcggtatttcttcttcggaagagagagagcggcgtacgggtgcggaacacgtgtgcaacctacctttatcagggggatagcctttcgaaaggaagattaataccccataatatattgaatggcatcatttaatattgaaaactccggtggatagagatgggcacgcgcaagattagatagttggtgaggtaacggctcaccaagtcaatgatctttagggggcctgagagggtgatcccccacactggtactgagacacggaccagactcctacgggaggcagcagtgaggaatattggacaatgggtgaaagcctgatccagccatcccgcgtgaaggacgacggccctatgggttgtaaacttcttttgtacagggataaacctttccacgtgtggaaagctgaaggtactgtacgaataagcaccggctaactccgtgccagcagccgcggtaatacggagggtgcaagcgttatccggatttattgggtttaaagggtccgtaggcggacctgtaagtcagtggtgaaatctcatagcttaactatgaaactgccattgatactgcaggtcttgagtaaatttgaagtggctggaataagtagtgtagcggtgaaatgcatagatattacttagaacaccaattgcgaaggcaggtcactaagatttaactgacgctgagggacgaaagcgtggggagcgaacaggattagataccctggtagtccacgccgtaaacgatgctaactcgtttttggattttcggattcagagaccaagcgaaagtgataagttagccacctggggagtacgtccgcaaggatgaaactcaaaggaattgacgggggcccgcacaagcggtggattatgtggtttaattcgatgatacgcgaggaaccttaccaagacttaaatgggaaatgacagatttagaaatagatccttcttcggacatttttcaaggtgctgcatggttgtcgtcagctcgtgccgtgaggtgttaggttaagtcctgcaacgagcgcaacccctgtcactagttgctaacattcagttgaggactctagtgagactgcctacgcaagtagagaggaaggtggggatgacgtcaaatcatcacggcccttacgtcttgggccacacacgtaatacaatggccggtacagagggcagctacacagcgatgtgatgcaaatctcgaaagccggtctcagttcggattggagtctgcaactcgactctatgaagctggaatcgctagtaatcgcgcatcagccatggcgcggtgaatacgttcccgggccttgtacacaccgcccgtcaagccatggaagtttggggtacctgaagtcggtgaccgtaaaaggagctgccta

SEQ ID NO: 565 - DNA, 1414 bp, Bacillus sp.
ctaccatgcagtcgacggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataaccttgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggctcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctca

SEQ ID NO: 566 - DNA, 1403 bp, Bacillus sp.
cagtcgacggcagcacagaatgagcttgctctttgggtggcgagtggcggacgggtgagtaatagtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataaccttgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggctcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtagttagcttaacctcgggagggct

SEQ ID NO: 567 - DNA, 1417 bp, Bacillus sp.
cacatgcagtcgagcggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataaccttgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggctcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccac

SEQ ID NO: 568 - DNA, 1417 bp, Pantoea sp.
catgcagtcgacggcagcacagaagagcttgctctttgggtggcgagtggcggacgggtgagtaatgtctgggaaactgcccgatggagggggataactactggaaacggtagctaataccgcataacgtcgcgagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataaccttgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaatttccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtgggtttaattcgatgcaacgcgaagaaccttacctggccttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccactt

SEQ ID NO: 569 - DNA, 1413 bp, Pantoea sp.
tcgacggcagcacagaagagcttgctctttgggtggcgagtggcggacgggtgagtaatgtctgggaaactgcccgatggagggggataactactggaaacggtagctaataccgcataacgtcgcgagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaaggtactttcagccgggggaggaaggcggtgaggttaataaccttgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattcccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccagaagaacttagcacagatgctttggtgccttcgggaactctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccactt

SEQ ID NO: 570 - DNA, 1432 bp, Pantoea sp.
tatacatgcagtcgagcgaacagataaggagcttgctcctttgacgttagcggcggacgggtgagtaacacgtggataacctacctataagactgggataacttcgggaaaccggagctaataccggataacatattgaaccgcatggttcaatagtgaaaggcggctttgctgtcacttatagatggatccgcgccgtattagctagttggtaaggtaacggcttaccaaggcaacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttatcagggaagaacaaatgtgtaagtaactgtgcacatcttgacggtacctgatcagaaagccacggctaactacgtgccagcagccgcggtaatacgtaggtggcaagcgttatccggaattattggggcgtaaagcgcgcgtaggcggtttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcggaagaaccttaccaaatcttgacatcctttgaccgctctagagatagagtcttccccttcgggggacaaagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacaatacaaagggcagctaaaccgcgaggtcaagcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccatttatggagctagccgtcga

SEQ ID NO: 571 - DNA, 1391 bp, Pantoea sp.
agcagtcgacggtgaaagagagcttgctctctggatcagtggcgaacgggtgagtaacacgtgagcaatctgcccctgactctgggataagcgctggaaacggcgtctaataccggatacgagctgcgaaggcatcttcagcagctggaaagaacttcggtcagggatgagctcgcggcctatcagctagttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggacgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaaacccgaggctcaacctcgggcctgcagtgggtacgggcagactagagtgcggtaggggagattggaattcctggtgtagcggtggaatgcgcagatatcaggaggaacaccgatggcgcaaaggcagatctctgggccgtaactgacgctgaggagcgaaagggtggggagcaaatcaggctttagataccctggtagtccaccccgtaaacgttgggaactagttgtggcgtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccatggcttgacatatacgagaacgctgcagaaatgtagaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtaaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcccaacccttgtggagggagcct

SEQ ID NO: 572 - DNA, 1379 bp, Pantoea sp.
tgcaagtcgaacgatgaagcccagcttgctgggtggattagtggcgaacgggtgagtaacacgtgagtaacctgcccttaactctgggataagcctgggaaactgggtctaataccggataggagcgcccaccgcatggtgggtgttggaaagatttatcggttttggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgcaagcctgatgcagcgacgccgcgtgagggatgacggccttcgggttgtaaacctctttcagtagggaagaagcgaaagtgacggtacctgcagaagaagcaccggctaactacgtgccagcagccgcggtaatacgtagggtgcgagcgttatccggaattattgggcgtaaagagctcgtaggcggtttgtcgcgtctgtcgtgaaagtccggggcttaaccccggatctgcggtgggtacgggcagactagagtgcagtaggggagactggaattcctggtgtagcggtggaatgcgcagatatcaggaggaacaccgatggcgaaggcaggtctctgggctgtaactgacgctgaggagcgaaagcatggggagcgaacaggattagataccctggtagtccatgccgtaaacgttgggcactaggtgtggggaccattccacggtttccgcgccgcagctaacgcattaagtgccccgcctggggagtacggccgcaaggctaaaactcaaaggaattgacggggggcccgcacaagcggcggagcatgcggattaatttgatgcaacgcgaagaaccttaccaaggcttgacatgttcctcgatcgctgtacagatacggtttcccctttgggacgggttcacaggtggtgcatggttgtagtcagctcgtgtcgtgagatgtagggttaagtcccgcaacgagcgcaaccctcgttccatgttgccagcacgtcgtggtggggaatcatgggaggctgccggggtcaactaggaggaaggtgaggacgacgtcaaatcatcatgccccttatgtcttgggcttcacgcatgctacaatggccggtacaatgggttgcgatactgtgaggtggagctaatcccaaaaagccggtctcagttcggatgggggtgtgcaactcgaccccatgaagtcggagtcgctagtaatcgcagatcagcaacgatgcggtgaatacgttcccgggccttgtacaccccgcccgtcaagtcacgaaagttggtaacacccgaagccggtggcctaaccctt

SEQ ID NO: 573 - DNA, 1398 bp, Pantoea sp.
accatgcagtcgaacgatgaagcccagcttgctgggtggattagtggcgaacgggtgagtaacacgtgagtaacctgcccttaactctgggataagcctgggaaactgggtctaataccggataggagcgtccaccgcatggtgggtgttggaaagatttatcggttttggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgcaagcctgatgcagcgacgccgcgtgagggatgacggccttcgggttgtaaacctctttcagtagggaagaagcgaaagtgacggtacctgcagaagaagcaccggctaactacgtgccagcagccgcggtaatacgtagggtgcgagcgttatccggaattattgggcgtaaagagctcgtaggcggtttgtcgcgtctgtcgtgaaagtccggggcttaaccccggatctgcggtgggtacgggcagactagagtgcagtaggggagactggaattccctggtgtagcggtggaatgcgcagatatcaggaggaacaccgatggcgaaggcaggtctctgggctgtaactgacgctgaggagcgaaagcatggggagcgaacaggattagataccctggtagtccatgccgtaaacgttgggcactaggtgtggggaccattccacggtttccgcgccgcagctaacgcattaagtgccccgcctggggagtacggccgcaaggctaaaactcaaaggaattgacgggggcccgcacaagcggcggagcatgcggattaattcgatgcaacgcgaagtagcttaccaaggcttgacatgttctcgatcgccgtagagatacggttttccctttggggcgggatcacaggatggtgcatggttgtcgtcagctcgtgtcgtgagatgttgggttaagtcccgcaacgagcgcaaccctcgttccatgttgccagcacgtaatggtggggactcatgggagactgccggggtcaactcggaggaaggtgaggacgacgtcaaatcatcatgccccttatgtcttgggcttcacgcatgctacaatggccggtacaatgggttgcgatactgtgaggtggagctaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagttggtaacacccgaagccggtggcctaacccttgtggggggagccgtcg

SEQ ID NO: 574 - DNA, 1396 bp, Pantoea sp.
ttgcagtcgaacgatgaagcccagcttgctgggtggattagtggcgaacgggtgagtaacacgtgagtaacctgcccttaactctgggataagcctgggaaactgggtctaataccggataggagcgtccaccgcatggtgggtgttggaaagatttatcggttttggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgcaagcctgatgcagcgacgccgcgtgagggatgacggccttcgggttgtaaacctctttcagtagggaagaagcgaaagtgacggtacctgcagaagaagcaccggctaactacgtgccagcagccgcggtaatacgtagggtgcgagcgttatccggaattattgggcgtaaagagctcgtaggcggtttgtcgcgtctgtcgtgaaagtccggggcttaacccccggatctgcggtgggtacgggcagactagagtgcagtaggggagactggaattccctggtgtagcggtggaatgcgcagatatcaggaggaacaccgatggcgaaggcaggtctctgggctgtaactgacgctgaggagcgaaagcatggggagcgaacaggattagataccctggtagtccatgccgtaaacgttgggcactaggtgtggggaccattccacggtttccgcgccgcagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgttctcgatcgccgtagagatacgggtttcccgtttggggcgggttcacaggacgatgtacgatgtcgtcagctcgtgtcgtgagatgttgggataagtcccgcaacgagcgcaaccctcgttccatgttgccagcacgtaatggtggggactcatgggagactgccggggtcaactcggaggaaggtgaggacgacgtcaaatcatcatgccccttatgtcttgggcttcacgcatgctacaatggccggtacaatgggttgcgatactgtgaggtggagctaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagttctggtaacacccgaagccggtggcctaacccttgtggggggagccgt

SEQ ID NO: 575 - DNA, 1407 bp, Chryseobacterium sp.
agcagtcgagcggacagatgggtagcttgctccctgatgttagcggcggacgggtgagtaacacgtgggtaacctgcctgtaagactgggataactccgggaaaccggggctaataccggatggttgtttgaaccgcatggttcaaacataaaaggtggcttcggctaccacttacagatggacccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtcgtgcatggttgtcgtcagctcgtgtcgtgagatgttgggttaagtcccgcaacgagcgcatcccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttag

SEQ ID NO: 576 - DNA, 1412 bp, Pantoea sp.
cagtcgagcgaacagacgaggagcttgctcctctgacgttagcggcggacgggtgagtaacacgtggataacctacctataagactgggataacttcgggaaaccggagctaataccggataatatattgaaccgcatggttcaatagtgaaagacggttttgctgtcacttatagatggatccgcgccgcattagctagttggtaaggtaacggcttaccaaggcaacgatgcgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacaaatgtgtaagtaactatgcacgtcttgacggtacctaatcagaaagcccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtgggagatcaaacaggattagataccctggtagtccacgccgtaaacgatgagtgctaagtgttagggggtttccgccccttagtgctgcagctaacgcattaagcactccgcctggggagtacgaccgcatggttgaaactcaaaggaattgacggggacccgcacaagcggtggagcatgtggtttaattcgaagcaacgcgaagtaccttaccaaatcttgacatcctctgacccctctagagatagagttttccccttcgggggacagagtgacaggtggtgcatggttgtcgtcagctcgtgtcgtgagatgatgggttatcacccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacaatacaaagggcagcgaaaccgcgaggtcaagcaaatcccataaagttgttctcagttcggattgtagtctgcaactcgactatatgaagctggaatcgctagtaatcgtagatcagcatgctacggtgaatacgttcccgggtcttgtacacaccgcccgtcacaccacgagagtttgtaacacccgaagccgttggagtaaccatttggagct

SEQ ID NO: 577 - DNA, 1404 bp, Pantoea sp.
cacatgcagtcgaacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaaggcttgacatacaccggaaacggccagagatggttgcccccgttgtggtcggtgtacaggtggagcatggggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagccgtcgaatg

SEQ ID NO: 578 - DNA, 1366 bp, Pantoea sp.
catgcaagtcgaacgaaggcttcggccttagtggcgcacgggtgcgtaacgcgtgggaatctgcccttaggttcggaataacagctggaaacggctgctaataccggatgatgacgaaagtccaaagatttatcgcctgaggatgagcccgcgttggattaggtagttggtggggtaaaggcctaccaagccgacgatccatagctggtctgagaggatgatcagccacactgggactgagacacggcccagactcctacgggaggcagcagtggggaatattggacaatgggcgaaagcctgatccagcaatgccgcgtgagtgatgaaggccctagggttgtaaagctcttttacccgggaagataatgactgtaccgggagaataagcccccggctaactccgtgccagcagccgcggtaatacggagggggctagcgttgttcggaattactgggcgtaaagcgcacgtaggcggctttgtaagtcagaggtgaaagcctggagctcaactccagaactgcctttgagactgcatcgcttgaatccaggagaggtcagtggaattccgagtgtagaggtgaaattcgtagatattcggaagaacaccagtggcgaaggcggctgactggactggtattgacgctgaggtgcgaaagcgtggggagcaaacaggattagataccctggtagtccacgccgtaaacgatgataactagctgtccgggcacttggtgcttgggtggcgcagctaacgcattaagttatccgcctggggagtacggccgcaaggttaaaactcaaaggaattgacgggggcctgcacaagcggtggagcatgtggtttaattcgaagcaacgcgcagaaccttaccagcgtttgacatgtccggacgatttccagagatggatctcttcccttcggggactggaaacacaggtgctgcatggctgtcgtcagctcgtgtcgtgagatgttggggttaagtccccgaacgagcgcaaccctcgcctttagttaccatcattgagttgggtactctaaaggaaccgccggtgataagccggaggaaggtggggatgacgtcaagtcctcatggcccttacgcgctgggctacacacgtgctacaatggcaactacagtgggcagcgaccctgcgagggcgagctaatccccaaaagttgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgttgcgccaacccgcaagggaagcaggcgaccacgg

SEQ ID NO: 579 - DNA, 1366 bp, Pantoea sp.
accatgcagtcgaacgaaggcttcggccttagtggcgcacgggtgcgtaacgcgtgggaatctgcccttaggttcggaataacagctggaaacggctgctaataccggatgatgacgaaagtccaaagatttatcgcctgaggatgagcccgcgttggattaggtagttggtggggtaaaggcctaccaagccgacgatccatagctggtctgagaggatgatcagccacactgggactgagacacggcccagactcctacgggaggcagcagtggggaatattggacaatgggcgaaagcctgatccagcaatgccgcgtgagtgatgaaggccctagggttgtaaagctcttttacccgggaagataatgactgtaccgggagaataagccccggtctaactccgtgccagcagccgcggtaatacggagggggctagcgttgttcggaattactgggcgtaaagcgcacgtaggcggctttgtaagtcagaggtgaaagccctggagctcaactccagaactgcctttgagactgcatcgcttgaatccaggagaggtcagtggaattccgagtgtagaggtgaaattcgtagatattcggaagaacaccagtggcgaaggcggctgactggactggtattgacgctgaggtgcgaaagcgtggggagcaaacaggattagataccctggtagtccacgccgtaaacgatgataactagctgtccgggcacttggtgcttgggtggcgcagctaacgcattaagttatccgcctggggagtacggccgcaaggttaaaactcaaaggaattgacgggggcctgcacaagcggtggagcatgtggtttaattcgaagcaacgcgcagaaccttaccagcgtttgacatgtccggacgatttccagagatggatctcttcccttcggggactggtacacaggtgctgcatggctgtcgtcagctcgtgtcgtgagatgttgggttaagtcccgcaacgagcgcaaccctcgcctttagttaccatcattgagttgggtactctaaaggaaccgccggtgataagccggaggaaggtggggatgacgtcaagtcctcatggcccttacgcgctgggctacacacgtgctacaatggcaactacagtgggcagcgaccctgcgagggcgagctaatccccaaaagttgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgttgcgccaacccgcaagggaagcaggcgaccacgg

SEQ ID NO: 580 - DNA, 1397 bp, Pantoea sp.
catgcagtcgaacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaaggcttgacatacaccggaaacggccagagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagccgtcgaa

SEQ ID NO: 581 - DNA, 1415 bp, Staphylococcus sp.
tagtcggacggtagcacagaggagcttgctcctcgggtgacgagtggcggacgggtgagtagtgtctggggatctgcccgatagagggggataaccactggaaacggtggctaataccgcataacgtcgcaagaccaaagagggggaccttcgggcctctcactatcggatgaacccagatgggattagctagtaggcggggtaacggcccacctaggcgacgatccctagctggtctgagaggatgaccagccacactggaactgagacacggtccagactcctacgggaggcagcagtggggaatattgcacagtgggcgcaagcctgatgcacccatgccgcgtgtatgaagaaggccttcgggttgtaaagtactttcagcggggaggaaggcgatgaggttaataaccttgttgattgacgttacccgcagaagaagcacccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcacgtgcgaaagcgtggggagcaaacacgattagataccctggtagtccacgccgtaaacgatgtcgacttggaggttgttcccttgacgagtggcttccggagctaacgcgttaagtcgaccgcctggggagtacggccgcaaggttaaaactcaaatgaattgacgggggcccgcacaagcggtggagcatgtggttttatttcgatgctacgcgaacaaccttaccctactcttgacatccacggaattcggcagagatgccttggtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgctaccacta

SEQ ID NO: 582 - DNA, 1426 bp, Microbacterium sp.
accatgcagtcggacggtagcacagaggagcttgctcctcgggtgacgagtggcggacgggtgagtagtgtctggggatctgcccgatagagggggataaccactggaaacggtggctaataccgcataacgtcgcaagaccaaagagggggaccttcgggcctctcactatcggatgaacccagatgggattagctagtaggcggggtaacggcccacctaggcgacgatccctagctggtctgagaggatgaccagccacactggaactgagacacggtccagactcctacgggaggcagcagtggggaatattgcacaatgggcgcaagcctgatgcacccatgccgcgtgtatgaagacggcctttcgcgggttgtaaagtactttccaagcggggaggaaggcgatgaggttaataaccttgttgattgacgttacccgcaggaagaagcaccggctaactccgtgccagcagccgcggtaatacggagggtgcaagcgttaatcggaattactgggcgtaaagcgcacgcaggcggtctgttaagtcagatgtgaaatccccgggcttaaccctgggaactgcatttgaaactggcaggcttgagtctcgtagaggggggtagaattccaggtgtagcggtgaaatgcgtagagatctggaggaataccggtggcgaaggcggccccctggacgaagactgacgctcacgtgcgaaagcgtggggagcaaacacgattacataccctggtagtccacgccgtaaacgatgtcgacttggaggttgttcccttgaggagtggcttcccgagctaacgcgttaagtcgaccgcctggcgagtacggccgcaaggttaaaactcaaatgaattgacgggggcccgcacaagcggtggagcatgtggtttaattccatgcatcgcgaagaaccttacctactcttgacatccaccgaacttagggcagagatgccttggtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgctaccact

SEQ ID NO: 583 - DNA, 1395 bp, Micrococcus sp.
ccatgcagtcgacgatgatgcccagcttgctgggtggattagtggcgaacgggtgagtaacacgtgagtaacctgcccctgactctgggataagcgttggaaacgacgtctaatactggatatgaccgccgatcgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacgggcagagatggtcgcccccttggtggtcggtgtacaggtggtgcatgggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagccgtcg

SEQ ID NO: 584 - DNA, 1422 bp, Micrococcus sp.
cacatgcagtcgaacggtaacaggaagcagcttgctgcttcgctgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgtggttaataaccgcgtcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaaccctgggaactgcatccgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacagaactttccagagatgggatttggtgccttcgggaactgtgagacaggtgctgcatggctgtcgtcagctcgtgttgtgaaatgttgggataagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcaaactcgcgagagccagcggacctcataaagtgcgtcgtagtccggattggagtctgcaactcgactccatgaagtcggaatcgctagtaatcgtgaatcagaatgtcacggtgaatacgttcccgggccttgtacacaccgcccgtcacaccatgggagtgggttgcaaaagaagtaggtagcttaaccttcgggagggcgcttaccactt

SEQ ID NO: 585 - DNA, 1420 bp, Micrococcus sp.
accatgcagtcggacggtagcacagaggagcttgctcctcgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaacggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcagtgaggttaataaccttactgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggcccgcaaggttaaaactcaaatgaattgacgggggcccgcacaagcggtggagcatgtggtttaattcgatgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaacctccgggagggcgcttaccactt

SEQ ID NO: 586 - DNA, 1402 bp, Bacillus sp.
catgcaagtcgaacgatgaagcggtgcttgcaccgtggattagtggcgaacgggtgagtaacacgtgagcaacctgccctggactctgggataagcgctggaaacggtgtctaatactggatatgagctctcatcgcatggtgggggttggaaagattttttggtctgggatgggctcgcggcctatcagcttgttggtgaggtaatggcttaccaaggcgtcgacgggtagccggcctgagagggtgaccggccacactgggactgagacacggcccagactcctacgggaggcagcagtggggaatattgcacaatgggcggaagcctgatgcagcaacgccgcgtgagggatgacggccttcgggttgtaaacctcttttagcagggaagaagcgtgagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatcccgaggctcaacctcgggtctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggaccattccacggtttccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatacaccagaacaccgtagaaatacgggactctttggacactgggtgaacaggtggtgcatggttgtcgtcagctcgtggtcgtgagatgttgggttaagtcccgcaacgagcgcaaccctcgttctatgttgccagcacgttatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcccaacccttgtggagggagccgtcgaaggtg

SEQ ID NO: 587 - DNA, 1399 bp, Staphylococcus sp.
catgcagtcgaacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacagccagagatggttgcccccttgtggtcggtgtacacgtggtgcatgggttgtcgtcagctcgtgtcgtgacttgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagccgtcgaatgg

SEQ ID NO: 588 - DNA, 1422 bp, Curtobacterium sp.
acatgcaagtcgaacggcagcacaggagagcttgctctctgggtggcgagtggcggacgggtgaggaatacatcggaatctaccttttcgtgggggataacgtagggaaacttacgctaataccgcatacgaccttagggtgaaagcggaggaccttcgggcttcgcgcggatagatgagccgatgtcggattagctagttggcggggtaaaggcccaccaaggcgacgatccgtagctggtctgagaggatgatcagccacactggaactgagacacggtccagactcctacgggaggcagcagtggggaatattggacaatgggcgcaagcctgatccagccatgccgcgtgggtgaagaaggccttcgggttgtaaagcccttttgttgggaaagaaaagcagtcggttaatacccgattgttctgacggtacccaaagaataagcaccggctaacttcgtgccagcagccgcggtaatacgaagggtgcaagcgttactcggaattactgggcgtaaagcgtgcgtaggtggttgtttaagtccgttgtgaaagccctgggctcaacctgggaattgcagtggatactgggcaactagagtgtggtagaggatggcggaattcccggtgtagcagtgaaatgcgtagagatcgggaggaacatctgtggcgaaggcggccatctggaccaacactgacactgaggcacgaaagcgtggggagcaaacaggattagataccctggtagtccacgccctaaacgatgcgaactggatgttgggtgcaacttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggtcttgacatccacggaactttccagagatggattggtgccttcgggaaccgtgagacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacgaccagggctacacacgtactacaatggtagggacagagggctgcaagccggcgacggtaagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgctgccacggt

SEQ ID NO: 589 - DNA, 1410 bp, Sphingomonas sp.
accatgcagtcgaacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaaaccctcttttagtagggaagaagcgtaagtgacggtacctgcagaaaaaagcaccgggctaactacgtgccagcagccgcggtaatacgtagggtgcaagcgttgtccgggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacagccagagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagccgtcgaaggtgattc

SEQ ID NO: 590 - DNA, 1393 bp, Sphingomonas sp.
caagtcgaacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaagcaccggctaactacgtgccagcagccgcggtaatacgtagggtgccaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagccgtcgaa

SEQ ID NO: 591 - DNA, 1418 bp, Curtobacterium sp.
ccatgcagtcgaacggcagcacaggagagcttgctctctgggtggcgagtggcggacgggtgaggaatacatcggaatctaccttttcgtgggggataacgtagggaaacttacgctaataccgcatacgaccttagggtgaaagcggaggaccttcgggcttcgcgcggatagatgagccgatgtcggattagctagttggcggggtaaaggcccaccaaggcgacgatccgtagctggtctgagaggatgatcagccacactggaactgagacacggtccagactcctacgggaggcagcagtggggaatattggacaatgggcgcaagcctgatccagccatgccgcgtgggtgaagaaggccttcgggttgtaaagcccttttgttgggaaagaaaagcagtcggttaatacccgattgttctgacggtacccaaagaataagcaccggctaacttcgtgccagcagccgcggtaatacgaagggtgcaagcgttactcggaattactgggcgtaaagcgtgcgtaggtggttgtttaagtccgttgtgaaagccctgggctcaacctgggaattgcagtggatactgggcaactagagtgtggtagaggatggcggaattcccggtgtagcagtgaaatgcgtagagatcgggaggaacatctgtggcgaaggcggccatctggaccaacactgacactgaggcacgaaagcgtggggagcaaacaggattagataccctggtagtccacgccctaaacgatgcgaactggatgttgggtgcaacttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggtcttgacatccacggaactttccagagatggattggtgccttcgggaaccgtgagacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacgaccagggctacacacgtactacaatggtagggacagagggctgcaagccggcgacggtaagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgctgccac

SEQ ID NO: 592 - DNA, 1425 bp, Pantoea sp.
accatgcaagtcgaacggcagcacagaggagcttgctccttgggtggcgagtggcggacgggtgaggaatacatcggaatctactctgtcgtgggggataacgtagggaaacttacgctaataccgcatacgacctacgggtgaaagcaggggatcttcggaccttgcgcgattgaatgagccgatgtcggattagctagttggcggggtaaaggcccaccaaggcgacgatccgtagctggtctgagaggatgatcagccacactggaactgagacacggtccagactcctacgggaggcagcagtggggaatattggacaatgggcgcaagcctgatccagccataccgcgtgggtgaagaaggccttcgggttgtaaagcccttttgttgggaaagaaatccatctggctaatacccgggtgggatgacggtacccaaagaataagcaccggctaacttcgtgccagcagccgcggtaatacgaagggtgcaagcgttactcggaattactgggcgtaaagcgtgcgtaggtggtcgtttaagtccgttgtgaaagcccctgggctcaacctgggaactgcagtggatactgggcgactagaatgtggtagagggtagcggaattcctggtgtagcagtgaaatgcgtagagatcaggaggaacatccatggcgaaggcagctacctggaccaacattgacactgaggcacgaaagcgtggggagcaaacaggattagataccctggtagtccacgccctaaacgatgcgaactggatgttgggtgcaatttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctgggccttgacatgtcgagaactttccagagatggatcggtgccttcgggaactcgaacacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacggccagggctacacacgtactacaatggtagggacagagggctgcaagccggcgacggtgagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgctgccacggt

SEQ ID NO: 593 - DNA, 1423 bp, Pantoea sp.
ccatgcagtcgaacggcagcacagaggagcttgctccttgggtggcgagtggcggacgggtgaggaatacatcggaatctactctgtcgtgggggataacgtagggaaacttacgctaataccgcatacgacctacgggtgaaagcaggggatcttcggaccttgcgcgattgaatgagccgatgtcggattagctagttggcggggtaaaggcccaccaaggcgacgatccgtagctggtctgagaggatgatcagccacactggaactgagacacggtccagactcctacgggaggcagcagtggggaatattggacaatgggcgcaagcctgatccagccataccgcgtgggtgaagaaggccttcgggttgtaaagcccttttgttgggaaagaaatccatctggctaatacccgggtgggatgacggtacccaaagaataagcaccggctaacttcgtgccagcagccgcggtaatacgaagggtgcaagcgttactcgggaattactgggcgtaaagcgtgcgtaggtggtcgtttaagtccgttgtgaaagccctgggctcaacctgggaactgcagtggatactgggcgactagaatgtggtagagggtagcggaattcctggtgtagcagtgaaatgcgtagagatcaggaggaacatccatggcgaaggcagctacctggaccaacattgacactgaggcacgaaagcgtggggagcaaacaggattagataccctggtagtccacgccctaaacgatgcgaactggatgttgggtgcaatttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctgggccttgacatgtcgagaactttccagagatggatcggtgccttcgggaactcgaacacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacggccagggctacacacgtactacaatggtagggacagagggctgcaagccggcgacggtgagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgctgccacgga

SEQ ID NO: 594 - DNA, 1436 bp, Curtobacterium sp.
atacatgcagtcgagcggacttgcatgagaagcttgcttctctgataggttagcggcggacgggtgagtaacacgtaggcaacctgccctcaagtttgggacaactaccggaaacggtagctaataccgaatagttgttttcttctcctgaaggaaactggaaagacggagcaatctgtcacttggggatgggcctgcggcgcattagctagttggtggggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaggtgacggtacctgagaagaaagcccccggctaactacgtgccagcagccgcggtaatacgtagggggcaagcgttgtccggaattattgggcgtaaagcgcgcgcaggcggtcatttaagtctggtgtttaatcccggggctcaaccccggatcgcactggaaactgggtgacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgagtgctaggtgttaggggtttcgatacccttggtgccgaagttaacacattaagcactccgcctggggagtacggtcgcaagactgaaactcaaaggaattgacggggacccgcacaagcagtggagtatgtggtttaattcgaagcaacgcgaagaaccttaccaaggtcttgacatccctctgaccggtacagagatgtaccttttccttcgggacagaggagacaggtggtgcatgggttgtcgtcagctcgtgtcctgaagcatgttgggttaagtcccgcaacgagcgcaacccttgatcttagttgccagcacttcgggtgggcactctaaggtgactgccggtgacaaaccggaggaaggtggggatgacgtcaaatcatcatgccccttatgacctgggctacacacgtactacaatggccggtacaacgggctgtgaagccgcgaggtggaacgaatcctaaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaaccgcaaggagccagccgccgaa

SEQ ID NO: 595 - DNA, 1430 bp, Enterobacter sp.
tacatgcaagtcgagcgaatcgatgggagcttgctccctgagattagcggcggacgggtgagtaacacgtgggcaacctgcctataagactgggataacttcgggaaaccggagctaataccggatacgttcttttctcgcatgagagaagatggaaagacggtttacgctgtcacttatagatgggcccgcggcgcattagctagttggtgaggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgaagaaggccttcgggtcgtaaagttctgttgttagggaagaacaagtaccagagtaactgctggtaccttgacggtacctaaccagaaagccacggctaactacgtgccagcagccgcggtaatacgtaggtggcaagcgttgtcccggaattattgggcgtaaagcgcgcgcaggtggttccttaagtctgatgtgaaagcccacggctcaaccgtggagggtcattggaaactggggaacttgagtgcagaagaggaaagtggaattccaagtgtagcggtgaaatgcgtagagatttggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaaccctagagatagggctttccccttcggggcacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaaacctgcgaaggtaagcgaatcccataaagccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtgaggtaaccttcatggagccagccgcctaatg

SEQ ID NO: 596 - DNA, 1442 bp, Pantoea sp.
ctatacatgcaagtcgagcggacttgcatgagaagcttgcttctctgataggttagcggcggacgggtgagtaacacgtaggcaacctgccctcaagtttgggacaactaccggaaacggtagctaataccgaatagttgttttcttctcctgaagaaaactggaaagacggagcaatctgtcacttggggatgggcctgcggcgcattagctagttggtggggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaaggtgacggtacctgagaagaaagccccggctaactacgtgcccagcagccgcggtaatacgtagggggcaagcgttgtccggaattattgggcgtaaagcgcgcgcaggcggtcatttaagtctggtgtttaatcccggggctcaaccccggatcgcactggaaactgggtgacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgagtgctaggtgttaggggtttcgatacccttggtgccgaagttaacacattaagcactccgcctggggagtacggtcgcaagactgaaactcaaaggaattgacggggacccgcacaagcagtggagtatgtggtttaattcgaagcaacgcgaagaaccttaccaggtcttgacatccctctgaccggtacagagatgtacctttccttcgggacagagcagacaggtggtgcatggttgtcgtcagctcgtgtcgtgagatgttgggttaagtcccgcaaggagccgcgatcccttgatcttagttgccagcacttcgggtgggcactctaaggtgactgccggtgacaaaccggaggaaggtggggatgacgtcaaatcatcatgccccttatgacctgggctacacacgtactacaatggccggtacaacgggctgtgaagccgcgaggtggaacgaatcctaaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaaccgcaaggagccagccgccgaaggtgg

SEQ ID NO: 597 - DNA, 1432 bp, Microbacterium sp.
acatgcaagtcgagcgaatcgatgggagcttgctccctgagattagcggcggacgggtgagtaacacgtgggcaacctgcctataagactgggataacttcgggaaaccggagctaataccggatacgttcttttctcgcatgagagaagatggaaagacggtttacgctgtcacttatagatgggcccgcggcgcattagctagttggtgaggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgaagaaggccttcgggtcgtaaagttctgttgttagggaagaacaagtaccagagtaactgctggtaccttgacggtacctaacccagaaagccaacggctaactacgtgccagcagccgcggtaatacgtaggtggcaagcgttgtccggaattattgggcgtaaagcgcgcgcaggtggttcccttaagtctgatgtgaaagcccacggctcaaccgtggagggtcattggaaactggggaacttgagtgcagaagaggaaagtggaattccaagtgtagcggtgaaatgcgtagagatttggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaaccctagagatagggctttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaaacctgcgaaggtaagcgaatcccataaagccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtgaggtaaccttcatggagccagccgcctaaagt

SEQ ID NO: 598 - DNA, 1428 bp, Curtobacterium sp.
acatgcaagtcgagcggacagatgggagcttgctccctgatgttagcggcggacgggtgagtaacacgtgggtaacctgcctgtaagactgggataactccgggaaaccggggctaataccggatggttgtttgaaccgcatggttcaaacataaaaggtggcttcggctaccacttacagatggacccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaacccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaaggtcttgacatcctctgacaatcctagagataggacgtccccttcgggggcagagtgacaggaggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccgaag

SEQ ID NO: 599 - DNA, 1441 bp, Xanthomonas sp.
ctatacatgcaagtcgagcggacttgcatgagaagcttgcttctctgataggttagcggcggacgggtgagtaacacgtaggcaacctgccctcaagtttgggacaactaccggaaacggtagctaataccgaatagttgttttcttctcctgaagaaaactggaaagacggagcaatctgtcacttggggatgggcctgcggcgcattagctagttggtggggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaggtgacggtacctgagaagaaagccccggctaactacgtgccagcagccgcggtaatacgtagggggcaagcgttgtccggaattattgggcgtaaagcgcgcgcaggcggtcatttaagtctggtgtttaatcccggggctcaaccccggatcgcactggaaactgggtgacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgagtgctaggtgttaggggtttcgatacccttggtgccgaagttaacacattaagcactccgcctggggagtacggtcgcaagactgaaactcaaaggaattgacggggacccgcacaagcagtggagtatgtggtttaattcgaagcaacgcgaagaaccttaccaggtcttgacatccctctgagcgggtacagagatgtaacgtttccttcgggacagaggagacaggtggtgcatggttgtcgtcagctcgtgtcgtgagatgttgggttaagtcccgcaacgagcgcaacccttgatcttagttgccagcacttcgggtgggcactctaaggtgactgccggtgacaaaccggaggaaggtggggatgacgtcaaatcatcatgccccttatgacctgggctacacacgtactacaatggccggtacaacgggctgtgaagccgcgaggtggaacgaatcctaaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaaccgcaaggagccagccgccgaaggtgtt

SEQ ID NO: 600 - DNA, 1433 bp, Curtobacterium sp.
atactgcagtcgagcgaatcgatgggagcttgctccctgagattagcggcggacgggtgagtaacacgtgggcaacctgcctataagactgggataacttcgggaaaccggagctaataccggatacgttcttttctcgcatgagagaagatggaaagacggtttacgctgtcacttatagatgggcccgcggcgcattagctagttggtgaggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgaagaaggccttcgggtcgtaaagttctgttgttagggaagaacaagtaccagagtaactgctggtaccttgacggtacctaaccagaaagccacggctaactacgtgcccagcagccgcggtaatacgtaggtggcaagcgttgtccggaattattgggcgtaaagcgcgcgcaggtggttccttaagtctgatgtgaaagcccacggctcaaccgtggagggtcattggaaactggggaacttgagtgcagaagaggaaagtggaattccaagtgtagcggtgaaatgcgtagagatttggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgcagctaacgcattaagcactccgcctggcgagtacggccgcaaggctgaaactcaaaggaattgacgggggcccgcacaagcggtggagcatgtggtttaattcgaagcaacgcgaagaaccttaccaggtcttgacatcctctgacaaccctagagatagggctttcccctttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaaacctgcgaaggtaagcgaatcccataaagccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtgaggtaaccttcatggagccagccgcctaagtgac

SEQ ID NO: 601 - DNA, 1426 bp, Curtobacterium sp.
gcaagtcgagcgaatcgatgggagcttgctccctgagattagcggcggacgggtgagtaacacgtgggcaacctgcctataagactgggataacttcgggaaaccggagctaataccggatacgttcttttctcgcatgagagaagatggaaagacggtttacgctgtcacttatagatgggcccgcggcgcattagctagttggtgaggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgaagaaggccttcgggtcgtaaagttctgttgttagggaagaacaagtaccagagtaactgctggtaccttgacggtacctaaccagaaaagccacggctaactacgtgccagcagccgcggtaatacgtaggtggcaagcgttgtccggaattattgggcgtaaagcgcgcgcaggtggttcctttaagtctgatgtgaaagcccacggctcaaccgtggagggtcattggaaactggggaacttgagtgcagaagaggaaagtggaattccaagtgtagcggtgaaatgcgtagagatttggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccagggtcttgacatcctctgacaaccctagagatagggctttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaaacctgcgaaggtaagcgaatcccataaagccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtgaggtaaccttcatggagccagccgcctaag

SEQ ID NO: 602 - DNA, 1429 bp, Xanthomonas sp.
tacatgcaagtcgagcgaatcagatgggagcttgctccctgagattagcggcggacgggtgagtaacacgtgggcaacctgcctataagactgggataacttcgggaaaccggagctaataccggatacgttcttttctcgcatgagagaagatggaaagacggtttacgctgtcacttatagatgggcccgcggcgcattagctagttggtgaggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgaagaaggccttcgggtcgtaaagttctgttgttagggaagaacaagtaccagagtaactgctggtaccttgacggtacctaaccagaaagccacggctaactacgtgccagcagccgcggtaatacgtaggtggcaagcgttgtccggaattattgggcgtaaagcgcgcgcaggtggttctttaagtctgatgtgaaagcccacggctcaaccgtggagggtcattggaaactggggaacttgagtgcagaagaggaaagtggaattccaagtgtagcggtgaaatgcgtagagatttggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaaccctagagatagggctttccccttcgggcgtcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaaacctgcgaaggtaagcgaatcccataaagccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtgaggtaaccttcatggagccagccgcctaag

SEQ ID NO: 603 - DNA, 1426 bp, Stenotrophomonas sp.
taatgcaagtcgagcggactttaaaagcttgcttttaaagttagcggcggacgggtgagtaacacgtgggcaacctgcctgtaagactgggataacttcgggaaaccggagctaataccggataatccttttctactcatgtagaaaagctgaaagacggtttacgctgtcacttacagatgggcccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtacaagagtaactgcttgtaccttgacggtacctaaccagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaatctgggggacttgagtgcagaagagaagagtggaattccacgtgtagcggtgaaatgcgtagagatgtggaggaacaccagtggcgaaggcgactctttggtctgtaactgacgctgaggcgcgaaagcgtggggagcaaacaggattagataccctggtagtccacgccgtaaacgatgagtgctaagtgttagagggtttccgccctttagtgctgcagcaaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacactcctagagataggacgttccccttcgggggacagagtgacaggtggtgcatggttgtcgtcagctcgtgtcgtgagatgttgggttaagtcccgcaacgagcgcaacccttgatcttagttgccagcattaagttgggcactttaaggtgactgccggtgacaaaccggaggaaggtggggatgacgtcaaatcatcatgccccttatgacctgggctacacacgtgctacaatggatggtacaaagggcagcaaaaccgcgaggtcgagcaaatcccataaaaccattctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaaccgtaaggagccagccgcctaagg

SEQ ID NO: 604 - DNA, 1429 bp, Stenotrophomonas sp.
ataatgcagtcgagcgaatcgatgggagcttgctccctgagattagcggcggacgggtgagtaacacgtgggcaacctgcctataagactgggataacttcgggaaaccggagctaataccggatacgttcttttctcgcatgagagaagatggaaagacggtttacgctgtcacttatagatgggcccgcggcgcattagctagttggtgaggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgaagaaggccttcgggtcgtaaagttctgttgttagggaagaacaagtaccagagtaactgctggtaccttgacggtacctaaccagaaagccacggctaactacgtgccagcagccgcggtaatacgtaggtggcaagcgttgtccggaattattgggcgtaaagcgcgcgcaggtggttcctttaagtctgatgtgaaagcccacggctcaaccgtggagggtcattggaaactggggaacttgagtgcagaagaggaaagtggaattccaagtgtagcggtgaaatgcgtagagatttggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaaccctagagatagggctttccccttcgggggacagagtgacaggtgggagcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaaacctgcgaaggtaagcgaatcccataaagccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtgaggtaaccttcatggagccagccgcctaag

SEQ ID NO: 605 - DNA, 1436 bp, Paenibacillus sp.
aatacatgcagtcgagcggacttgcatgagaagcttgcttctctgatggttagcggcggacgggtgagtaacacgtaggcaacctgccctcaagcttgggacaactaccggaaacggtagctaataccgaatagttgttttcttctcctgaagaaaactggaaagacggagcaatctgtcacttggggatgggcctgcggcgcattagctagttggtggggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaggtgacggtacctgagaagaaagccccggctaactacgtgcccagcagccgcggtaatacgtagggggcaagcgttgtccggaattattgggcgtaaagcgcgcgcaggcggtcatttaagtctggtgtttaatcccggggctcaaccccggatcgcactggaaactgggtgacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgagtgctaggtgttaggggtttcgatacccttggtgccgaagttaacacattaagcactccgcctggggagtacggtcgcaagactgaaactcaaaggaattgacggggacccgcacaagcagtggagtatgtgggtttaattcgaagcaacgcgaagaacccttaccaggtcttgacatccctctgaacgggtacagagatgtaacttttccttcgggacagaggacacaggtggtgcatggttgtcgtcagctcgtgtcgtgagatgttgggttaagtcccgcaacgagcgcaacccttgatcttagttgccagcacttcgggtgggcactctaaggtgactgccggtgacaaaccggaggaaggtggggatgacgtcaaatcatcatgccccttatgacctgggctacacacgtactacaatggccggtacaacgggctgtgaagccgcgaggtggaacgaatcctaaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaaccgcaaggagccagccgccgatg

SEQ ID NO: 606 - DNA, 1428 bp, Bacillus sp.
ctatacatgcagtcgagcggacagatgggagcttgctccctgatgttagcggcggacgggtgagtaacacgtgggtaacctgcctgtaagactgggataactccgggaaaccggggctaataccggatggttgtttgaaccgcatggttcaaacataaaaggtggcttcggctaccacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagcgttgtccgggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataaggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccg

SEQ ID NO: 607 - DNA, 1408 bp, Paenibacillus sp.
accatgcagtcgaacggtgaagccaagcttgcttggtggatcagtggcgaacgggtgagtaacacgtgagcaacctgccctggactctgggataagcgctggaaacggcgtctaatactggatatgagacgtgatcgcatggtcgtgtttggaaagatttttcggtctgggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcggaagcctgatgcagcaacgccgcgtgagggatgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatcccgaggctcaacctcgggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggaccattccacggtttccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttgggacactcgtaaacaggtgggtgcatgggtagtcgtcagctcgtgtcgtgagatgttggggttaagtcccgcaacgagcgcaaccctcgttctatgttgccagcacgtaatggaggggaactcatggggaaactgccggggtgaactcggcaggaacgaggggtagacgtcaaatcatcatgccccttatgtcttgggcttcacgcatgctacaatggccggtacaaagggctgcaataccgtaaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcccaacccttgtggagggagccgtcgaaggtg

SEQ ID NO: 608 - DNA, 1429 bp, Bacillus sp.
tacatgcagtcgagcggacttgcatgagaagcttgcttctctgataggttagcggcggacgggtgagtaacacgtaggcaacctgccctcaagcttgggacaactaccggaaacggtagctaataccgaatagttgttttcttctcctgaagaaaactggaaagacggagcaatctgtcacttggggatgggcctgcggcgcattagctagttggtggggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaggtgacggtacctgagaagaaagccccggctaactacgtgccagcagccgcggtaatacgtagggggcaagcgttgtccggaattattgggcgtaaagcgcgcgcaggcggtcatttaagtctggtgtttaatcccggggctcaaccccggatcgcactggaaactgggtgacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgagtgctaggtgttaggggtttcgatacccttggtgccgaagttaacacattaagcactccgcctggggagtacggtcgcaagactgaaactcaaaggaattgacggggacccgcacaagcagtggagtatgtggtttaattcgaagcaacgcgaagaaccttaccaggtcttgacatccctctgaccggtacagagatgtatctttccttcgggacagaggagacaggtggtgcatggttgtcgtcagctcgtgtcgtgagatgttgggttaagtcccgcaacgagcgcaacccttgatcttagttgccagcacttcgggtgggcactctaaggtgactgccggtgacaaaccggaggaaggtggggatgacgtcaaatcatcatgccccttatgacctgggctacacacgtactacaatggccggtacaacgggctgtgaagccgcgaggtggaacgaatcctaaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaaccgcaaggagccagccgccgaa

SEQ ID NO: 609 - DNA, 1378 bp, Bacillus sp.
cagtctatacatgcaagtcgaacgagatcttcggatctagtggcgcacgggtgcgtaacgcgtgggaatctgcccttgggttcggaataacttctggaaacggaagctaataccggatgatgacgtaagtccaaagatttatcgcccaaggatgagcccgcgtaggattagctagttggtggggtaaaggcccaccaaggcgacgatccttagctggtctgagaggatgatcagccacactgggactgagacacggcccagactcctacgggaggcagcagtagggaatattggacaatgggcgaaagcctgatccagcaatgccgcgtgagtgatgaaggccttagggttgtaaagctcttttacccgggatgataatgacagtaccgggagaataagctccggctaactccgtgccagcagccgcggtaatacggagggagctagcgttgttcggaattactgggcgtaaagcgcacgtaggcggctattcaagtcagaggtgaaagcccggggctcaaccccggaactgcctttgaaactagatagcttgaatccaggagaggtgagtggaattccgagtgtagaggtgaaattcgtagatattcggaagaacaccagtggcgaaggcggctcactggactggtattgacgctgaggtgcgaaagcgtggggagcaaacaggattagataccctggtagtccacgccgtaaacgatgataactagctgtcagggcacatggtgttttggtggcgcagctaacgcattaagttatccgcctggggagtacggtcgcaagattaaaactcaaaggaattgacgggggcctgcacaagcggtggagcatgtggtttaattcgaagcaacgcgcagaaccttaccaacgtttgacatccctatcgcggatcgtgggagacactttccttcagttcggctggataggtgacaggtgctgcatggctgtcgtcagctcgtgtcgtgagatgttggggttaagtcccgcaacgagcgcaaccctcgcctttagttgccagcatttagttgggtactctaaaggaaccgccggtgataagccggaggaaggtggggatgacgtcaagtcctcatggcccttacgcgttgggctacacacgtgctacaatggcgactacagtgggcagccacctcgcgagagggagctaatctccaaaagtcgtctcagttcggatcgttctctgcaactcgagagcgtgaaggcggaatcgctagtaatcgcggatcagcatgccgcggtgaatacgttcccaggccttgtacacaccgcccgtcacaccatgggagttggattcactcgaaggcgttgagctaaccgtaaggaggcaggcgaccacagtgta

SEQ ID NO: 610 - DNA, 1440 bp, Paenibacillus sp.
ctatactgcagtcgagcgaatcgatgggagcttgctccctgagattagcggcggacgggtgagtaacacgtgggcaacctgcctataagactgggataacttcgggaaaccggagctaataccggatacgttcttttctcgcatgagagaagatggaaagacggtttacgctgtcacttatagatgggcccgcggcgcattagctagttggtgaggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgaagaaggccttcgggtcgtaaagttctgttgttagggaagaacaagtaccagagtaactgctggtaccttgacggtacctaaccagaaagccaccggctaactacgtgcccagcagccgcggtaatacgtaggtttggcaagcgattagaccggaattattggggccgtaaacccccccggctggaggttcccttactctgatgtgaaagcccacggctcaaccgtggagggtcattggaaactggggaacttgagtgcagaagaggaaagtggaattccaagtgtagcggtgaaatgcgtagagatttggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaaccctagagatagggctttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaaacctgcgaaggtaagcgaatcccataaagccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtgaggtaaccttcatggagccagccgcctaagg

SEQ ID NO: 611 - DNA, 1399 bp, Bacillus sp.
taccatgcagtcgaacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagccgtcgaag

SEQ ID NO: 612 - DNA, 1360 bp, Bacillus sp.
ccatgcagtcgagcgggcccttcggggtcagcggcggacgggtgagtaacgcgtgggaacgtgccttctggttcggaataaccctgggaaactagggctaataccggatacgcccttttggggaaaggtttactgccggaagatcggcccgcgtctgattagctagttggtggggtaacggcctaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctcttttatccgggacgataatgacggtactcggaggaataagccccggctaacttcgtgccagcagccgcggtaatacgaagggggctagcgttgctcggaatcactgggcgtaaagggcgcgtaggcggcgttttaagtcgggggtgaaagcctgtggctcaaccacagaatggccttcgatactgggacgcttgagtatggtagaggttggtggaactgcgagtgtagaggtgaaattcgtagatattcgcaagaacaccggtggcgaaggcggccaactggaccattactgacgctgaggcgcgaaagcgtggggagcaaacaggattagataccctggtagtccacgccgtaaacgatgaatgccagctgttggggtgcttgcaccgcagtagcgcagctaacgctttgagcattccgcctggggagtacggtcgcaagattaaaactcaaaggaattgacgggggcccgcacaagcggtggagcatgtggtttaattcgaagcaacgcgcagaaccttaccatcctttgacatggcgtgttacccagagagatctggggtccccttcgggggcgcgcacacaggtgctgcatggctgtcgtcagctcgtgtcgtgagatgttgggttaagtcccgcaacgagcgcaacccacgtccttagttgccatcattcagttgggcactctagggagactgccggtgataagccgcgaggaaggtgtggatgacgtcaagtcctcatggcccttacgggatgggctacacacgtgctacaatggcggtgacagtgggaggcgaaggagcgatctggagcaaatccccaaaagccgtctcagttcggattgcactctgcaactcgagtgcatgaaggcggaatcgctagtaatcgtggatcagcatgccacggtgaatacgttcccgggccttgtacacaccgcccgtcacaccatgggagttggtcttacccgacggcgctgcgccaaccgcaaggaggcaggcgaccactg

SEQ ID NO: 613 - DNA, 1363 bp, Bacillus sp.
atgcagtcgagcgggcccttcggggtcagcggcggacgggtgagtaacgcgtgggaacgtgccttctggttcggaataaccctgggaaactagggctaataccggatacgcccttttggggaaaggtttactgccggaagatcggcccgcgtctgattagctagttggtggggtaacggcctaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttaggggttgtaaagctcttttattccgggacgataatgacggtaccggaggaataagccccggctaacttcgtgccagcagccgcggtaatacgaagggggctagcgttgctcggaatcactgggcgtaaagggcgcgtaggcggcgttttaagtcgggggtgaaagcctgtggctcaaccacagaatggccttcgatactgggacgcttgagtatggtagaggttggtggaactgcgagtgtagaggtgaaattcgtagatattcgcaagaacaccggtggcgaaggcggccaactggaccattactgacgctgaggcgcgaaagcgtggggagcaaacaggattagataccctggtagtccacgccgtaaacgatgaatgccagctgttggggtgcttgcaccgcagtagcgcagctaacgctttgagcattccgcctggggagtacggtcgcaagattaaaactcaaaggaattgacgggggcccgcacaagcggtggagcatgtggtttaattcgaagcaacgcgcagaaccttaccatcctttgacatggcgtgttacccagagagatctggggtccccttcgggggcgcgcacacaggtgctgcatggctgtcgtcagctcgtgtcgtgagatgttgggttaagtcccgcaacgagcgcaacccacgtccttagttgccatcatttagttggggcactcttcggagactggcggtgattagccgcgaggaaggagtgggatgacgtcaaggtcctcatgggcccttacgggatgggctacacacgtgctacaatggcggtgacagtgggaggcgaaggagcgatctggagcaaatccccaaaagccgtctcagttcggattgcactctgcaactcgagtgcatgaaggcggaatcgctagtaatcgtggatcagcatgccacggtgaatacgttcccgggccttgtacacaccgcccgtcacaccatgggagttggtcttacccgacggcgctgcgccaaccgcaaggaggcaggcgaccactg

SEQ ID NO: 614 - DNA, 1362 bp, Bacillus sp.
taccatgcagtcgagcggacctttcggggtcagcggcggacgggtgagtaacgcgtgggaacgtgccttctggttcggaataaccctgggaaactagggctaataccggatacgcccttatggggaaaggtttactgccggaagatcggcccgcgtctgattagctagttggtggggtaacggcctaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctcttttatccgggacgataatgacggtaccggaggaataagccccggctaacttcgtgccagcagccgcggtaatacgaagggggctagcgttgctcggaatcactgggcgtaaagggcgcgtaggcggcgttttaagtcgggggtgaaagcctgtggctcaaccacagaatggccttcgatactgggacgcttgagtatggtagaggttggtggaactgcgagtgtagaggtgaaattcgtagatattcgcaagaacaccggtggcgaaggcggccaactggaccattactgacgctgaggcgcgaaagcgtggggagcaaacaggattagataccctggtagtccacgccgtaaacgatgaatgccagctgttggggtgcttgcaccgcagtagcgcagctaacgctttgagcattccgcctggggagtacggtcgcaagattaaaactcaaaggaattgacgggggcccgcacaagcggtggagcatgtggtttaattcgaagcaacgcgcagaaccttaccatcctttgacatggcgtgttacccagagagatttggggtccacttcggtggcgcgcacacaggtgctgcatggctgtcgtcagctcgtgtcgtgagatgttgggttaagtcccgcaacgagcgcaacccacgtccttagttgccatcattcagttgggcactctagggagactgccggtgataagccgcgaggaaggtgtggatgacgtcaagtcctcatggcccttacgggatgggctacacacgtgctacaatggcggtgacagtgggacgcgaaggagcgatctggagcaaatccccaaaagccgtctcagttcggattgcactctgcaactcgagtgcatgaaggcggaatcgctagtaatcgtggatcagcatgccacggtgaatacgttcccgggccttgtacacaccgcccgtcacaccatgggagttggtcttacccgacggcgctgcgccaaccgcaaggaggcaggcgaccacgat

SEQ ID NO: 615 - DNA, 1399 bp, Bacillus sp.
atgcagtcgaacgatgatgcccagcttgctgggtggattagtggcgaacgggtgagtaacacgtgagtaacctgcccctgactctgggataagcgttggaaacgacgtctaatactggatatgatcactggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggcctttccgggttgtaaacctcttttagtagggaagaaagcgaaagtgacggtaccttgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcatggggagcgaacaggattagataccctggtagtccatgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacgggccagagatggtcgcccccttgtggtcggtgtacaggtggtgcatggttgtcgtcagctcgtgtcgtgagatgttgggttaagtcccgcaacgagcgcaaccctcgttctatgttgccagcgggttatgccggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagccgtcgaa

SEQ ID NO: 616 - DNA, 1399 bp, Paenibacillus sp.
ccatgcagtcgacggtgaagccaagcttgcttggtggatcagtggcgaacgggtgagtaacacgtgagcaacctgccctggactctgggataagcgctggaaacggcgtctaatactggatatgagacgtgatcgcatggtcgtgtttggaaagatttttcggtctgggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcggaagcctgatgcagcaacgccgcgtgagggatgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatcccgaggctcaacctcgggtctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggaccattccacggtttccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaaggcttgacatatacgagaacgggccagaaatgggacaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcccaacccttgtggagggagccgtcgaatg

SEQ ID NO: 617 - DNA, 1429 bp, Bacillus sp.
tatacatgcaagtcgagcggacagaagggagcttgctcccggatgttagcggcggacgggtgagtaacacgtgggtaacctgcctgtaagactgggataactccgggaaaccggagctaataccggatagttccttgaaccgcatggttcaaggatgaaagacggtttcggctgtcacttacagatggacccgcggcgcattagctagttggtggggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgcgagagtaactgctcgcaccttgacggtacctaaccagaaagccacggctaactacgtgccagcagccgcggtaatacgtaggtggcaagcgttgtcccggaattattgggcgtaaagggctcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaaccctagagatagggctttcccttcggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggctgcaagaccgcaaggtttagccaatcccataaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgcaacacccgaagtcggtgaggtaacctttatggagccagccgccgaaa

SEQ ID NO: 618 - DNA, 1429 bp, Microbacterium sp.
atacatgcaagtcgagcggacagatgggagcttgctccctgatgttagcggcggacgggtgagtaacacgtgggtaacctgcctgtaagactgggataactccgggaaaccggggctaataccggatgcttgtttgaaccgcatggttcaaacataaaaggtggcttcggctaccacttacagatggacccgcggcgcattagctagttggtgaggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtgggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccgaag

SEQ ID NO: 619 - DNA, 1426 bp, Paenibacillus sp.
taccatgcagtcgaacggcagcacaggagagcttgctctctgggtggcgagtggcggacgggtgaggaatacatcggaatctaccttttcgtgggggataacgtagggaaacttacgctaataccgcatacgaccttagggtgaaagcggaggaccttcgggcttcgcgcggatagatgagccgatgtcggattagctagttggcggggtaaaggcccaccaaggcgacgatccgtagctggtctgagaggatgatcagccacactggaactgagacacggtccagactcctacgggaggcagcagtggggaatattggacaatgggcgcaagcctgatccagccatgccgcgtgggtgaagaaggccttcgggttgtaaagcccttttgttgggaaagaaaagcagtcggttaatacccgattgttctgacggtacccaaagaataagcaccggctaacttcgtgcccagcagccgcggtaatacgaagggtgcaagcgttactcggaattactgggcgtaaagcgtgcgtaggtggttgtttaagtccgttgtgaaagccctgggctcaacctgggaattgcagtggatactgggcaactagagtgtggtagaggatggcggaattcccggtgtagcagtgaaatgcgtagagatcgggaggaacatctgtggcgaaggcggccatctggaccaacactgacactgaggcacgaaagcgtggggagcaaacaggattagataccctggtagtccacgccctaaacgatgcgaactggatgttgggtgcaacttggcacgcagtatcgaagctaacgcgttaagttcgccgcctggggagtacggtcgcaagactgaaactcaaaggaattgacgggggcccgcacaagcggtggagtatgtgggtttaattcgatgcaacgcgaagaacccttacctgggtcttgacatccacggaactttccagagatggattggtgccttcgggaaccgtgagacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacgaccagggctacacacgtactacaatggtagggacagagggctgcaagccggcgacggtaagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgctgccacgg

SEQ ID NO: 620 - DNA, 1394 bp, Sphingobium sp.
gcatgcagtcgacgatgaagcccagcttgctgggtggattagtggcgaacgggtgagtaacacgtgagtaacctgcccttaactctgggataagcctgggaaactgggtctaataccggatatgagcgcctaccgcatggtgggtgttggaaagatttatcggttttggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcagtagggaagaagcgaaagtgacggtacctgcagaagaagcaccggctaactacgtgccagcagccgcggtaatacgtagggtgcgagcgttatccggaattattgggcgtaaagagctcgtaggcggtttgtcgcgtctgtcgtgaaagtccggggcttaaccccggatctgcggtgggtacgggcagactagagtgcagtaggggagactggaattcctggtgtagcggtggaatgcgcagatatcaggaggaacaccgatggcgaaggcaggtctctgggctgtaactgacgctgaggagcgaaagcatggggagcgaacaggattagataccctggtagtccatgccgtaaacgttgggcactaggtgtggggaccattccacggtttccgcgccgcagctaacgcattaagtgccccgcctggggagtacggccgcaaggctaaaactcaaaggaattgacgggggcccgcacaagcggcggagcatgcggattaattcgatgcaacgcgaagtagcttaccaaggcttgacatgtactcgatcggcgtagagatacggtttcccgttaggggcgggttctgtggtggtgcatggttgtcgtcagctcgtgtcgtgagatgttgggttaagtcccgcaacgagcgcaaccctcgttccatgttgccagcacgtcgtggtggggactcatgggagactgccggggtcaactcggaggaaggtgaggacgacgtcaaatcatcatgccccttatgtcttgggcttcacgcatgctacaatggccggtacaatgggttgcgatactgtgaggtggagctaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagttggtaacacccgaagccggtggcctaacccttgtggggggagccgtac

SEQ ID NO: 621 - DNA, 1421 bp, Bacillus sp.
atgcagtcgagcgaatcgatgggagcttgctccctgagattagcggcggacgggtgagtaacacgtgggcaacctgcctataagactgggataacttcgggaaaccggagctaataccggatacgttcttttctcgcatgagagaagatggaaagacggtttacgctgtcacttatagatgggcccgcggcgcattagctagttggtgaggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgaagaaggccttcgggtcgtaaagttctgttgttagggaagaacaagtaccagagtaactgctggtaccttgacggtacctaaccagaaagccacggctaactacgtgccagcagccgcggtaatacgtaggtggcaagcgttgtccggaattattgggcgtaaagcgcgcgcaggtggttccttaagtctgatgtgaaagcccacggctcaaccgtggagggtcattggaaactggggaacttgagtgcagaagaggaaagtggaatttccaagtgtagcggtgaaatgcgtagagatttggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgcagctaacgcattaagcactccgcctggggagtacggccgcaaggctgaaactcaaaggaattgacgggggcccgcacaagcggtggagcatgtggtttaattcgaacgatcccgttctaccttaccaggtgatgacatcctctgacaaccctagagatagggctttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaaacctgcgaaggtaagcgaatcccataaagccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtgaggtaaccttcatggagccagccgcc

SEQ ID NO: 622 - DNA, 1419 bp, Curtobacterium sp.
ccatgcagtcggacggtagcacagaggagcttgctcctcgggtgacgagtggcggacgggtgagtaatgtctggggatctgcccgatagagggggataaccactggaaacggtggctaataccgcaaaacgtcgcaagaccaaagagggggaccttcgggcctctcactatcggatgaacccagatgggattagctagtaggcggggtaacggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgtggttaataaccgcgtcgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaatttccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggattaaactcaaatgaattgacgggggcccgcacaagcggtggagcatgtggtttaattcgatgcaacgcgaagaaccatacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggctagcttaaccttcgggagggcgctaccactt

SEQ ID NO: 623 - DNA, 1436 bp, Methylobacterium sp.
atacatgcagtcgagcggacttgcatgagaagcttgcttctctgatggttagcggcggacgggtgagtaacacgtaggcacctgccctcaagcttgggacaactaccggaaacggtagctaataccgaatagttgttttcttctcctgaagaaaactggaaagacggagcaatctgtcacttggggatgggcctgcggcgcattagctagttggtggggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaggtgacggtacctgagaagaaagccccggctaactacgtgccagcagccgcggtaatacgtagggggcaagcgttgtccggaattattgggcgtaaagcgcgcgcaggcggtcatttaagtctggtgtttaatcccggggctcaaccccggatcgcactggaaactgggtgacttgagtgcagaagaggagagtggaattccacgtgtagcggtgaaatgcgtagatatgtggaggaacaccagtggcgaagcgcgactctctgggctgtaactgacgctgaggcgcgaaagcgtggggagcaaacaggattagataccctggtagtccacgccgtaaacgatgagtgctaggtgttaggggtttcgatacccttggtgccgaagttaacacattaagcactccgcctggggagtacggtcgcaagactgaaactcaaaggaattgacggggacccgcacaagcagtggagtatgtggttttattcgaagcaacgcgaagaaccttaccaggtcttgacatccctctgaccggtacagagatgtacctttccttcgggacagaggagacaggtggtgcatggttgtcgtcagctcgtgtcgtgagatgttgggttaagtcccgcaacgagcgcaacccttgatcttagttgccagcacttcgggtgggcactctaaggtgactgccggtgacaaaccggaggaaggtggggatgacgtcaaatcatcatgccccttatgacctgggctacacacgtactacaatggccggtacaacgggctgtgaagccgcgaggtggaacgaatcctaaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaaccgcaaggagccagccgccgaaggtgatc

SEQ ID NO: 624 - DNA, 1355 bp, Methylobacterium sp.
atagcagtcgacgccccgcaggggagtggcagacgggtgagtaacgcgtgggaacataccctttcctgcggaatagctccgggaaactggaattaataccgcatacgccctacgggggaaagatttatcggggaaggattggcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctctttcaccggagaagataatgacggtatccggagaagaagccccggctaacttcgtgccagcagccgcggtaatacgaagggggctagcgttgttcggaattactgggcgtaaagcgcacgtaggcggatatttaagtcaggggtgaaatcccagagctcaactctggaactgcctttgatactgggtatcttgagtatggaagaggtaagtggaattccgagtgtagaggtgaaattcgtagatattcggaggaacaccagtggcgaaggcggcttactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagctcttgacattcggggtttgggcagtggagacattgtccttcagttaggctgggcccagaacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagacagcgatgtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttttacccgaaggtagtgcgctaaccgcaaggaggcagctatcca

SEQ ID NO: 625 - DNA, 1422 bp, Methylobacterium sp.
acacatgcagtcgagcggtagagaggtgcttgcacctcttgagagcggcggacgggtgagtaaagcctaggaatctgcctggtagtgggggataacgctcggaaacggacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcattaacctaatacgttagtgttttgacgttaccgacagaataagcaccggctaactctgtgccagcagccgcggtaatacagagggtgcaagcgttaatcggaattactgggcgtaaagcgcgcgtaggtggttcgttaagttggatgtgaaatccccgggctcaacctgggaactgcattcaaaactgtcgagctagagtatggtagagggtggtggaatttcctgttgtagcggtgaaatgcgtgatacagatataggaaggaacaccagtggcgaaggcgacccacctggactgatactgacactgaggtgcgaaagcgtggggagcaaacaggattagataccctgggtagtccacgcccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagtaccttaccaggccttgacatcctatgaactttccagagatggattggtgccttcgggaacattgagacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcggggggacggtaccacg

SEQ ID NO: 626 - DNA, 1400 bp, Curtobacterium sp.
cctgcagtcgaacggcagcacgggggcaccctggtggcgagtggcgaacgggtgagtaatacatcggaacgtgtcctgtagtgggggatagcccggcgaaagccggattaataccgcatacgatctgtggatgaaagcgggggatcttaggacctcgcgctacaggggcggccgatggcagattagctagttggtggggtaaaggcctaccaaggcgacaatatgtagctggtctgagaggacgaccagccacactgggactgagacacggcccagactcctacgggaggcagcagtggggaattttggacaatgggcgcaagcctgatccagcaatgccgcgtgtgtgaagaaggccttcgggttgtaaagcacttttgtccggaaagaaaacctcttggttaatacctgagggggatgacggtaccggaagaataagcaccggctaactacgtgccagcagccgcggtaatacgtagggtgcaagcgttaatcggaattactgggcgtaaagcgtgcgcaggcggttcgctaagacagatgtgaaatccccgggcttaacctgggaactgcatttgtgactggcgggctagagtatggcagaggggggtagaatttccacgtgtagcagtgaaatgcgtagagatgtggaggaataccgatggcgaaggctgccccctgggccaatactgacgctcatgcacgaaagcgtggggagcaaacaggattagataccctggtagtccacgccctaaacgatgtcaactagttgtcgggtcttcattgacttggtaacgtagcttacgcgtgaagttgaccgcctggggagtacggtcgcaagaataaaactcaaaggaattgacggggacccgcacaagcggtggatgatgtggattaattcgatgcaacgcgaaaaaccatacctacccatgacatgtatggaatcctgctgacacgagggagtgcccgaaagggagccataacacaggtgctgcatggctgtcgtcagctcgtgtcgtgagatgttgggttaagtcccgcaacgagcgcaacccttgtccctagttgctacgcaagagcactctagggagactgccggtgacaaaccggaggaaggtggggatgacgtcaagtcctcatggcccttatgggtagggcttcacacgtcatacaatggtcggaacagagggtcgccaacccgcgagggggagccaatcccagaaaaccgatcgtagtccggatcgcactctgcaactcgagtgcgtgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtct

SEQ ID NO: 627 - DNA, 1401 bp, Microbacterium sp.
ccatgcagtcgaacggcagcacgggtgcttgcacctggtggcgagtggcgaacgggtgagtaatacatcggaacatgtcctgtagtgggggatagcccggcgaaagccggattaataccgcatacgatccacggatgaaagcgggggaccttcgggcctcgcgctatagggttggccgatggctgattagctagttggtggggtaaaggcccaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatcctgagggctaatatccttcggggatgacggtaccggaagaataagcaccggctaactacgtgccagcagccgcggtaatacgtagggtgcgagcgttaatcggaattactgggcgtaaagcgtgcgcaggcggtttgttaagaccgatgtgaaatccccgggctcaacctgggaactgcattggtgactggcaagctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctagagagatctgggagtgctcgaaagagaaccgatacacaggtgctgcatggctgtcgtcagctcgtgtcgtgagatgttgggttaagtcccgcaacgagcgcaacccttgtccttagttgctacgcaagagcactctagggagactgccggtgacaaaccggaggaaggtggggatgacgtcaagtcctcatggcccttatgggtagggcttcacacgtcatacaatggtcggaacagagggtcgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggt

SEQ ID NO: 628 - DNA, 1419 bp, Bacillus sp.
cacatgcagtcgaacggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtgaggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataacctcgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaagcttacctgggccttgacatccagagaacttagcagagatgctttggtgccttcggggactctgagacaggtgctgcatggctgtcgtcagctcgtgttgtgaaatgttgggttaagtcccgcaacgagcgcaacccttatcctttgttgccagcggttcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccattt

SEQ ID NO: 629 - DNA, 1396 bp, Bacillus sp.
gaacggcagcacgggtgcttgcacctggtggcgagtggcgaacgggtgagtaatacatcggaacatgtcctgtagtgggggatagcccggcgaaagccggattaataccgcatacgatccacggatgaaagcgggggaccttcgggcctcgcgctatagggttggccgatggctgattagctagttggtggggtaaaggcccaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatcctgagggctaatatccttcggggatgacggtaccggaagaataagcaccggctaactacgtgccagcagccgcggtaatacgtagggtgcgagcgttaatcggaattactgggcgtaaagcgtgcgcaggcggtttgttaagaccgatgtgaaatccccgggctcaaccctgggaactgcattggtgactggcaagctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttgggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctagagagatctgggagtgctcgaaagagaaccgatacacaggtgctgcatggctgtcgtcagctcgtgtcgtgagatgttgggttaagtcccgcaacgagcgcaacccttgtccttagttgctacgcaagagcactctagggagactgccggtgacaaaccggaggaaggtggggatgacgtcaagtcctcatggcccttatgggtagggcttcacacgtcatacaatggtcggaacagagggtcgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcac

SEQ ID NO: 630 - DNA, 1417 bp, Xanthomonas sp.
acacatgcagtcgaacggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtgaggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataacctcgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgctacgcgaagaaccttacctggccttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccac

SEQ ID NO: 631 - DNA, 1419 bp, Micrococcus sp.
acatgcagtcgaacggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataaccttgccgattgacgttacccgcagaagaagcaccggctaactccgtgcccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggcgagtacggccgcaaggttaaaactcaaatgaattgacgggggcccgcacaagcggtggagcatgtggtttaattcgatgcaacgcgaagaaccttacctgggccttgacatccagagaacttagcagagatgctttggacgcttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccatag

SEQ ID NO: 632 - DNA, 1393 bp, Bacillus simplex
acttgaagagaagcttgcttctctgatggttagcggcggacgggtgagtaacacgtaggcaacctgccctcaagcttgggacaactaccggaaacggtagctaataccgaatacttgttttcttcgcctgaagagaactggaaagacggagcaatctgtcacttggggatgggcctgcggcgcattagctagttggtgaggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaggtgacggtacctgagaagaaagccccggctaactacgtgccagcagccgcggtaatacgtagggggcaagcgttgtccggaattattgggcgtaaagcgcgcgcaggcggtcatgtaagtctggtgtttaatcccggggctcaaccccggatcgcactggaaactgcgtgacttgagtgcagaagaggagagtggaattccacgtgtagcggtgaaatgcgtagagatgtggaggaacaccagtggcgaaggcgactctctgggctgtaactgacgctgaggcgcgaaagcgtggggagcaaacaggattagataccctggtagtccacgccgtaaacgatgagtgctaggtgttaggggtttcgatacccttggtgccgaagttaacacattaagcactccgcctggggagtacggtcgcaagactgaaactcaaaggaattgacggggacccgcacaagcagtggagtatgtggtttaattcgaagcaacgcgaagaaccttaccaggtcttgacatccaactaacgaggcagagatgcgttaggtgcccttcggggaaagttgagacaggtggtgcatggttgtcgtcagctcgtgtcgtgagatgttgggttaagtcccgcaacgagcgcaacccttatatttagttgccagcacttcgggtgggcactctagatagactgccggtgacaaaccggaggaaggtggggatgacgtcaaatcatcatgccccttatgacctgggctacacacgtactacaatggccggtacaacgggcagcgaaatcgcgagatggagccaatcccaacaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaac

SEQ ID NO: 633 - DNA, 1401 bp, Pantoea ananatis
gaagcttgcttccttgatacttagcaggcggacgggtgagtaacacgtaggcaacctgccctcaagcttgggacaactaccggaaacggtagctaataccgaatacttgttttcttcgcctgaagggaactggaaagacggagcaatctgtcacttgaggatgggcctgcggcgcattagctagttggtgaggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctcccaaggtgacggtacctgagaagaaagccccggctaactacgtgccagcagccgcggtaatacgtagggggcaagcgttgtccggaattattgggcgtaaagcgcgcgcaggcggtcatgtaagtctggtgtttaatcccggggctcaaccccggatcgcactggaaactgcgtgacttgagtgcagaagaggagagtggaattccacgtgtagcggtgaaatgcgtagagatgtggaggaacaccagtggcgaaggcgactctctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaggtcttgacatccaactaacgaggtagagatacgttaggtgcccttcggggaaagttgagacaggtggtgcatggttgtcgtcagctcgtgtcgtgagatgttgggttaagtcccgcaacgagcgcaacccttgatcttagttgccagcacttcgggtgggcactctaaggtgactgccggtgacaaaccggaggaaggtggggatgacgtcaaatcatcatgccccttatgacctgggctacacacgtactacaatggccggtacaacgggcagtgaaaccgcgaggtggaacgaatcctaaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaaccgcaaggagccagcctc

SEQ ID NO: 634 - DNA, 1429 bp, Paenibacillus taichungensis
tacatgcaagtcgagcggacagaagggagcttgctcccggatgttagcggcggacgggtgagtaacacgtgggtaacctgcctgtaagactgggataactccgggaaaccggagctaataccggatagttccttgaaccgcatggttcaaggatgaaagacggtttcggctgtcacttacagatggacccgcggcgcattagctagttggtggggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgcgagagtaactgctcgcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtgggagcatgtgggtttaattcgaagcaacgcgaagaaccttaccaggtcttgacatcctctgacatccctagagatagggctttcccttcggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggctgcaagaccgcaaggtttagccaatcccataaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgcaacacccgaagtcggtgaggtaacctttatggagccagccgccgatgg

SEQ ID NO: 635 - DNA, 1418 bp, Agrobacterium tumefaciens
cacatgcagtcgaacggtagcacagaggagcttgctcctcgggtgacgagtggcggacgggtgagtaatgtctgggaaactgcccgatggagggggataactactggaaacggtagctaataccgcataacgtcgcaagaccaaagagggggaccttcgggcctcttgccatcggatgtgcccagatgggattagctggttggtgaggtaatggctcaccaaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcggggaggaaggcgatacggttaataaccgtgttgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggcttgagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaattaggcagagatgccttagtgccttcgggaaccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcatatacaaagagaagcgacctcgcgagagcaagcggacctcataaagtatgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgctaccatag

SEQ ID NO: 636 - DNA, 1388 bp, Pseudomonas sp.
gcagtcgaacggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataaccttgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagctt

SEQ ID NO: 637 - DNA, 1394 bp, Burkholderia phytofirmans
atgcagtcgaacggtgaacacggagcttgctctgtgggatcagtggcgaacgggtgagtaacacgtgagcaacctgcccctgactctgggataagcgctggaaacggcgtctaatactggatatgtgacgtgatcgcatggtctgcgtctggaaagaatttcggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggacgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatccggaggctcaacctccggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcctaacccttgtggagggagccgtcg

SEQ ID NO: 638 - DNA, 1409 bp, Burkholderia sp.
cacatgcagtcgaacggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataacctcgccgattgacgttacccgcagaagaagcaccggctaactccgtgccagcagccgcggtaatacggagggtgcaagcgttaatcggaattactgggcgtaaagcgcacgcaggcggtcatgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggc

SEQ ID NO: 639 - DNA, 1419 bp, Erwinia sp.
cacatgcagtcgaacggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataacctcgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctgggccttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctactcata

SEQ ID NO: 640 - DNA, 1410 bp, Burkholderia sp.
tcgaacggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataacctcgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctgggccttgacatccagagaacttagcagagatgctttgggtgccttcgggaactctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccata

SEQ ID NO: 641 - DNA, 1392 bp, Erwinia sp.
acttgcagtcgaacggtgaagccaagcttgcttggtggatcagtggcgaacgggtgagtaacacgtgagcaacctgccctggactctgggataagcgctggaaacggcgtctaatactggatatgagccttcatcgcatggtgggggttggaaagattttttggtctgggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatcccgaggctcaacctcgggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggaccattccacggtttccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatacaccagaacgggccagaaatggtcaactctttggacactggtgaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcccaacccttgtggagggagccta

SEQ ID NO: 642 - DNA, 1398 bp, Erwinia sp.
gcacatgcagtcgaacggtgaagccaagcttgcttggtggatcagtggcgaacgggtgagtaacacgtgagcaacctgccctggactctgggataagcgctggaaacggcgtctaatactggatatgagacgtgatcgcatggtcgtgtttggaaagatttttcggtctgggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagcagggaagaagcgaaagtgacggtacctgcagaaaaaagcgccggctaactacgtgccagcagccgcggtaatacgtagggcgcaagcgttatccgggaattattgggcgtaaagagctcgtaggcggtttgtcgcgtctgctgtgaaatcccgaggctcaacctcgggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggaccattccacgggtttccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcccaacccttgtggagggagccgtc

SEQ ID NO: 643 - DNA, 1391 bp, Paenibacillus sp.
acatgcagtcgaacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaagcaccgggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaagggcttgacatacaccggaaacggccagagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagc

SEQ ID NO: 644 - DNA, 1420 bp, Paenibacillus sp.
acatgcagtcggacggtagcacagaggagcttgctccttgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaatggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgcggttaataaccgcgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaacctttacctactcttgacatccagcgaacggggcagagatgccgccgagtgtgcttcgggtacgctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgctaccata

SEQ ID NO: 645 - DNA, 1386 bp, Bacillus sp.
agcagtcgaacggcagcacgggtgcttgcacctggtggcgagtggcgaacgggtgagtaatacatcggaacatgtcctgtagtgggggatagcccggcgaaagccggattaataccgcatacgatctacggatgaaagcgggggaccttcgggcctcgcgctatagggttggccgatggctgattagctagttggtggggtaaaggcccaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatcctgagggctaatatccttcggggatgacggtaccggaagaataagcaccggctaactacgtgccagcagccgcggtaatacgtagggtgcgagcgttaatcggaattactgggcgtaaagcgtgcgcaggcggtttgttaagaccgatgtgaaatccccgggctcaacctgggaactgcattggtgactggcaagctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctggagagatctgggagtgctcgaaagagaaccgatacacaggtgctgcatggctgtcgtcagctcgtgtcgtgagatgttgggttaagtcccgcaacgagcgcaacccttgtccttagttgctacgcaagagcactctagggagactgccggtgacaaaccggaggaaggtggggatgacgtcaagtcctcatggcccttatgggtagggcttcacacgtcatacaatggtcggaacagagggtcgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaacctg

SEQ ID NO: 646 - DNA, 1386 bp, Enterobacteriaceae; identical to SEQ ID NO: 645

SEQ ID NO: 647 - DNA, 1362 bp, Erwinia sp.
cacatgcagtcgaacgagatcttcgggtctagtggcgcacgggtgcgtaacgcgtgggaatctgccctttggttcggaataacagttggaaacgactgctaataccggatgatgacgaaagtccaaagatttatcgccagaggatgagcccgcgtaggattagctagttggtgtggtaaaggcgcaccaaggcgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggatgataatgacagtaccgggagaataagctccggctaactccgtgccagcagccgcggtaatacggagggagctagcgttgttcggaattactgggcgtaaagcgcacgtaggcggctttgtaagttagaggtgaaagcctggagctcaactccagaactgcctttaagactgcatcgcttgaatccaggagaggtgagtggaattccgagtgtagaggtgaaattcgtagatattcggaagaacaccagtggcgaaggcggctcactggactggtattgacgctgaggtgcgaaagcgtggggagcaaacaggattagataccctggtagtccacgccgtaaacgatgataactagctgtccggggacttggtctttgggtggcgcagctaacgcattaagttatccgcctggggagtacggccgcaaggttaaaactcaaatgaattgacgggggcctgcacaagcggtggagcatgtggtttaattcgaagcaacgcgcagaaccttaccagcgtttgacatgtccggacgatttccagagatggatctcttcccttcggggactggaacacaggtgctgcatggctgtcgtcagctcgtgtcgtgagatgttgggttaagtcccgcaacgagcgcaaccctcgcctttagttaccatcatttagttggggactctaaaggaaccgccggtgataagccggaggaaggtggggatgacgtcaagtcctcatggcccttacgcgctgggctacacacgtgctacaatggcggtgacagtgggcagcaaactcgcgagagtgcgctaatctccaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttgggttcacccgaaggcgttgcgctaactcgcaagagaggcaggcgaccat

SEQ ID NO: 648 - DNA, 1400 bp, Microbacterium sp.
aagtcgaacggcagcacgggtgcttgcacctggtggcgagtggcgaacgggtgagtaatacatcggaacatgtcctgtagtgggggatagcccggcgaaagccggattaataccgcatacgatctacggatgaaagcgggggaccttcgggcctcgcgctatagggttggccgatggctgattagctagttggtggggtaaaggcccaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatcctgagggctaatatccttcggggatgacggtaccggaagaataagcaccggctaactacgtgccagcagccgcggtaatacgtagggtgcgagcgttaatcggaattactgggcgtaaagcgtgcgcaggcggtttgttaagaccgatgtgaaatccccgggctcaacctgggaactgcattggtgactggcaagctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctggagagatctgggagtgctcgaaagagaaccgatacacaggtgctgcatggctgtcgtcagctcgtgtcgtgagatgttgggttaagtcccgcaacgagcgcaacccttgtccttagttgctacgcaagagcactctagggagactgccggtgacaaaccggaggaaggtggggatgacgtcaagtcctcatggcccttatgggtagggcttcacacgtcatacaatggtcggaacagagggtcgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcacc

SEQ ID NO: 649 - DNA, 1391 bp, Erwinia sp.
acatgcagtcgaacggtgaagccaagcttgcttggtggatcagtggcgaacgggtgagtaacacgtgagcaacctgccctggactctgggataagcgctggaaacggcgtctaatactggatatgagcctcttccgcatggtgggggttggaaagattttttggtctgggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcggaagcctgatgcagcaacgccgcgtgagggatgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatcccgaggctcaacctcgggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggaccattccacggtttccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatacaccagaacgggccagaaatggtcaactctttggacactggtgaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcccaacccttgtggagggagccg

SEQ ID NO: 650 - DNA, 1396 bp, Erwinia sp.
gcaagtcgaacggtgaacacggagcttgctctgtgggatcagtggcgaacgggtgagtaacacgtgagcaacctgcccctgactctgggataagcgctggaaacggcgtctaatactggatatgtgacgtgatcgcatggtctgcgtctggaaagaatttcggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggacgacggccttcgggttgtaaacctcttttagcagggaagaagcgaaagtgacggtaccctgcagaaaaagcgccggctaactacgtgccagcagccgcggtaatacgtagggcgcaagcgttatccggaattattgggcgtaaagagctcgtaggcggtttgtcgcgtctgctgtgaaatccggaggctcaacctccggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcctaacccttgtggagggagccgtcgaa

SEQ ID NO: 651 - DNA, 1419 bp, Erwinia sp.
atgcagtcgagcgaatggattaagagcttgctcttatgaagttagcggcggacgggtgagtaacacgtgggtaacctgcccataagactgggataactccgggaaaccggggctaataccggataatattttgaactgcatggttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaagcttaccatggtcttgacatcctctgaaaaccctagagatagggcttctccttcgggagcagagtgacaggtggtgcatggttgtcgtcagctcgtgtcgtgagatgttgggttaagtcccgcaacgagcgcaacccttgatcttagttgccatcattaagttgggcactctaaggtgactgccggtgacaaaccggaggaaggtggggatgacgtcaaatcatcatgccccttatgacctgggctacacacgtgctacaatggacggtacaaagagctgcaagaccgcgaggtggagctaatctcataaaaccgttctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaaccttttggagccagccg

SEQ ID NO: 652 - DNA, 1361 bp, Microbacterium sp.
catgcagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccactgtag

SEQ ID NO: 653 - DNA, 1350 bp, Microbacterium sp.
gtaggcaacctgccctcaagcttgggacaactaccggaaacggtagctaataccgaatacttgttttcttcgcctgaagggaactggaaagacggagcaatctgtcacttgaggatgggcctgcggcgcattagctagttggggaggtaacggctcaccaaggcgacgatgcgtagccgacctgagagggtgatcggccacactgggactgaaacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctcccaaggtgacggtacctgagaagaaagccccggctaactacgtgccagcagccgcggtaatacgtagggggcaagcgttgtccggaattattgggcgtaaagcgcgcgcaggcggtcatgtaagtctggtgtttaatcccggggctcaaccccggatcgcactggaaactgcgtgacttgagtgcagaagaggagagtggaattccacgtgtagcggtgaaatgcgtagagatgtggaggaacaccagtggcgaaggcgactctctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaggtcttgacatccaactaacgaggcagagatgcgttaggtgcccttcggggaaagttgagacaggtggtgcatggttgtcgtcagctcgtgtcgtgagatgttgggttaagtcccgcaacgagcgcaacccttgatcttagttgccagcacttcgggtgggcactctaaggtgactgccggtgacaaaccggaggaaggtggggatgacgtcaaatcatcatgccccttatgacctgggctacacacgtactacaatggccggtacaacgggcagtgaagccgcgaggtggaacgaatcctaaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaaccgcaaggagcca

SEQ ID NO: 654 - DNA, 1360 bp, Curtobacterium sp.
catagcaagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaacccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagaatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccac

SEQ ID NO: 655 - DNA, 1408 bp, Erwinia sp.
cacatgcagtcgaacggcagcacggacttcggtctggtggcgagtggcgaacgggtgagtaatgtatcggaacgtgcccagtagcgggggataactacgcgaaagcgtagctaataccgcatacgccctacgggggaaagcaggggatcgtaagaccttgcactattggagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggttaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagcttaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttggtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaatgccgaagagatttggcagtgctcgcaagagaaccggtacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgataccactag

SEQ ID NO: 656 - DNA, 1365 bp, Burkholderia sp.
acatgcaagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagaatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccactataat

SEQ ID NO: 657 - DNA, 1418 bp, Burkholderia sp.
agcagtcgagcggagttgatgggaaagcttgcttccctgagacttagcggcggacgggtgagtaacacgtaggcaacctgccctcaagcttgggacaactaccggaaacggtagctaataccgaatacttgttttcttcgcctgaagggaactggaaagacggagcaatctgtcacttgaggatgggcctgcggcgcattagctagttggtgaggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctcccaaggtgacggtacctgagaagaaagccccggctaactacgtgccagcagccgcggtaatacgtagggggcaagcgttgtccggaattattgggcgtaaagcgcgcgcaggcggtcatgtaagtctggtgtttaatcccggggctcaaccccggatcgcactggaaactgcgtgacttgagtgcagaagaggagagtggaattccacgtgtagcggtgaaatgcgtagagatgtggaggaacaccagtggcgaaggcgactctctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccagggtcttgacatccaactaacgaggtagagatacgttaggtgcccttcggggaaagttgagacaggtggtgcatggttgtcgtcagctcgtgtcgtgagatgttgggttaagtcccgcaacgagcgcaacccttgatcttagttgccagcacttcgggtgggcactctaaggtgactgccggtgacaaaccggaggaaggtggggatgacgtcaaatcatcatgccccttatgacctgggctacacacgtactacaatggccggtacaacgggcagtgaaaccgcgaggtggaacgaatcctaaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaactgcaaggagcc

SEQ ID NO: 658 - DNA, 1402 bp, Sphingomonas sp.
catgcagtcgaacggcagcacggacttcggtctggtggcgagtggcgaacgggtgagtaatgtatcggaacgtgcccagtagcgggggataactacgcgaaagcgtagctaataccgcatacgccctacgggggaaagcaggggatcgtaagaccttgcactattggagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggttaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagcttaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttggtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaatgccgaagagatttggcagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgatacca

SEQ ID NO: 659 - DNA, 1362 bp, Burkholderia sp.
cacatgcagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacggcggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccactgta

SEQ ID NO: 660 - DNA, 1426 bp, Microbacterium sp.
tacatgcaagtcgagcgaacagaagggagcttgctcccggatgttagcggcggacgggtgagtaacacgtgggtaacctgcctgtaagactgggataactccgggaaaccggagctaataccggatagttccttgaaccgcatggttcaaggatgaaagacggtttcggctgtcacttacagatggacccgcggcgcattagctagttggtggggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgcgagagtaactgctcgcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaaccctagagatagggctttcccttcggggacagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggacagaacaaagggctgcgagaccgcaaggtttagccaatcccataaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgcaacacccgaagtcggtgaggtaacctttatggagccagccgccgatg

SEQ ID NO: 661 - DNA, 1412 bp, Microbacterium sp.
gcaagagaagcttgcttctctgatgcgttagcggcggacgggtgagtaacacgtaggcaacctgccctcaagcttgggacaactaccggaaacggtagctaataccgaatacttgttttcttcgcctgaagagaactggaaagacggagcaatctgtcacttggggatgggcctgcggcgcattagctagttggtgaggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaggtgacggtacctgagaagaaagccccggctaactacgtgccagcagccgcggtaatacgtagggggcaagcgttgtccgggaattattgggcgtaaagcgcgcgcaggcggtcatgtaagtctggtgtttaatcccggggctcaaccccggatcgcactggaaactgtgtgacttgagtgcagaagaggagagtggaattccacgtgtagcggtgaaatgcgtagagatgtggaggaacaccagtggcgaaggcgactctctgggctgtaactgacgctgaggcgcgaaagcgtggggagcaaacaggattagataccctggtagtccacgccgtaaacgatgagtgctaggtgttaggggtttcgatacccttggtgccgaagttaacacattaagcactccgcctggggagtacggtcgcaagactgaaactcaaaggaattgacggggacgcgcacaagcagtggagtatgtggtttaattcgaagcaacgcgaagaaccttaccagggtcttgacatccaactaacgaggcagagatgcatcaggtgcccttcggggaaagttgagacaggtggtgcatggttgtcgtcagctcgtgtcgtgagatgttgggttaagtcccgcaacgagcgcaacccttatatttagttgccagcatttcggatgggcactctagatagactgccggtgacaaaccggaggaaggtggggatgacgtcaaatcatcatgccccttatgacctgggctacacacgtactacaatggccggtacaacgggctgcgaaatcgcgagatggagccaatcccaacaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaaccgcaaggagccagcctccg

SEQ ID NO: 662 - DNA, 1393 bp, Bacillus sp.
cttgaagagaagcttgcttctctgatggttagcggcggacgggtgagtaacacgtaggcaacctgccctcaagcttgggacaactaccggaaacggtagctaataccgaatacttgttttcttcgcctgaagagaactggaaagacggagcaatctgtcacttggggatgggcctgcggcgcattagctagttggtgaggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaggtgacggtacctgagaagaaagccccggctaactacgtgccagcagccgcggtaatacgtagggggcaagcgttgtccggaattattgggcgtaaagcgcgcgcaggcggtcatgtaagtctggtgtttaatcccggggctcaaccccggatcgcactggaaactgtgtgacttgagtgcagaagaggagagtggaattccacgtgtagcggtgaaatgcgtagagatgtggaggaacaccagtggcgaaggcgactctctgggctgtaactgacgctgaggcgcgaaagcgtggggagcaaacaggattagataccctggtagtccacgccgtaaacgatgagtgctaggtgttaggggtttcgatacccttggtgccgaagttaacacattaagcactccgcctggggagtacggtcgcaagactgaaactcaaaggaattgacggggacccgcacaagcagtgcagtatgtggtttaattcgaagcaacgcgaagaaccttaccaggtcttgacatccaactaacgaggcagagatgcatcaggtgcccttcggggaaagttgagacaggtggtgcatggttgtcgtcagctcgtgtcgtgagatgttgggttaagtcccgcaacgagcgcaacccttatatttagttgccagcacttcggatgggcactctagatagactgccggtgacaaaccggaggaaggtggggatgacgtcaaatcatcatgccccttatgacctgggctacacacgtactacaatggccggtacaacgggctgcgaaatcgcgagatggagccaatcccaacaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaact

SEQ ID NO: 663 - DNA, 1399 bp, Ochrobactrum sp.
acacatgcagtcgaacggtgaacacggagcttgctctgtgggatcagtggcgaacgggtgagtaacacgtgagcaacctgcccctgactctgggataagcgctggaaacggcgtctaatactggatatgtgacgtgatcgcatggtctgcgtctggaaagaatttcggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggacgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatccggaggctcaacctccggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttggacactcgtaaacagggtggtgcatgggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcctaacccttgtggagggagccgtc

SEQ ID NO: 664 - DNA, 1355 bp, Paenibacillus sp.
catagcagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgtcc

SEQ ID NO: 665 - DNA, 1411 bp, Ochrobactrum sp.
tacacatgcagtcgaacggcagcacggacttcggtctggtggcgagtggcgaacgggtgagtaatgtatcggaacgtgcccagtagcgggggataactacgcgaaagcgtagctaataccgcatacgccctacgggggaaagcaggggatcgtaagaccttgcactattggagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggttaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagcttaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttggtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaatgccgaagagatttggcagtgctcgcaagagatccggaacacaggtgctgcatggctgtcgtcagctcgtgtcgtgagatgttgggataagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgataccactagt

SEQ ID NO: 666 - DNA, 1429 bp, Achromobacter sp.
actacatgcaagtcgagcggacagaagggagcttgctcccggatgttagcggcggacgggtgagtaacacgtgggtaacctgcctgtaagactgggataactccgggaaaccggagctaataccggatagttccttgaaccgcatggttcaaggatgaaagacggtttcggctgtcacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgcaagagtaactgcttgcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccagggtcttgacatcctctgacaaccctagagatagggctttcccttcggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggctgcgagaccgcaaggtttagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgcaacacccgaagtcggtgaggtaacctttatggagccagccgccgatg

SEQ ID NO: 667 - DNA, 1424 bp, Ochrobactrum sp.
tacatgcagtcgagcggacttaaaaagcttgctttttaagttagcggcggacgggtgagtaacacgtgggcaacctgcctgtaagactgggataacttcgggaaaccggagctaataccggataatcctttcctactcatgtaggaaagctgaaagacggtttacgctgtcacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtacgagagtaactgctcgtaccttgacggtacctaaccagaaagccacggctaactacgtgccagcagccgcggtaatacgtaggtggcaagcgttgtccgggaattattgggcgtaaagcgcgcgcaggcggtcctttaagtctgatgtgaaagcccacggctcaaccgtggagggtcattggaaactgggggacttgagtgcagaagagaagagtggaattccacgtgtagcggtgaaatgcgtagagatgtggaggaacaccagtggcgaaggcgactctttggtctgtaactgacgctgaggcgcgaaagcgtggggagcaaacaggattagataccctggtagtccacgccgtaaacgatgagtgctaagtgttagagggtttccgccctttagtgctgcagcaaacgcattaagcactccgcctggggagtacggccgcaaggctgaaactcaaaggaattgacgggggcccgcacaagcggtggagcatgtggtttaattcgaagcaacgcgaagaaccttaccaggtcttgacatctcctgacaatcctagagataggacgttccccttcgggggacaggatgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggcagcaaaaccgcgaggtcgagccaatcccataaaaccattctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaacccttctgggagccagccgcct

SEQ ID NO: 668 - DNA, 1418 bp, Paenibacillus sp.
catgcagtcgagcggacagaagggagcttgctcccggatgttagcggcggacgggtgagtaacacgtgggtaacctgcctgtaagactgggataactccgggaaaccggagctaataccggatagttccttgaaccgcatggttcaaggatgaaagacggtttcggctgtcacttacagatggacccgcggcgcattagctagttggtggggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgcgagagtaactgctcgcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaacgctagagatagggctttcccttcggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggctgcaagaccgcaaggtttagccaatcccataaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgcaacacccgaagtcggtgaggtaacctttatggagccagccgc

SEQ ID NO: 669 - DNA, 1369 bp, Achromobacter sp.
agacagtcgagcggtaaggcctttacggggtacacgagcggcgaacgggtgagtaacacgtgggtgatctgccctgcacttcgggataagcctgggaaactgggtctaataccggatatgacctcctatcgcatggtgggtggtggaaagatttatcggtgcaggatgggcccgcggcctatcagcttgttggtggggtaatggcctaccaaggcgacgacgggtagccgacctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggacgaagcgcaagtgacggtacctgcagaagaagcaccggctaactacgtgccagcagccgcggtaatacgtagggtgcaagcgttgtccggaattactgggcgtaaagagttcgtaggcggtttgtcgcgtcgtttgtgaaaaccagcagctcaactgctggcttgcaggcgatacgggcagacttgagtactgcaggggagactggaattcctggtgtagcggtgaaatgcgcagatatcaggaggaacaccggtggcgaaggcgggtctctgggcagtaactgacgctgaggaacgaaagcgtgggtagcgaacaggattagataccctggtagtccacgccgtaaacggtgggcgctaggtgtgggttccttccacggaatccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggtttgacatataccggaaagctgcagagatgtggccccccttgtggtcggtatacaggtggtgcatggctgtcgtcagctcgtgtcgtgagatgttgggttaagtcccgcaacgagcgcaacccctatcttatgttgccagcacgttatggtggggactcgtaagagactgccggggtcaactcggaggaaggtggggacgacgtcaagtcatcatgccccttatgtccagggcttcacacatgctacaatggccagtacagagggctgcgagaccgtgaggtggagcgaatcccttaaagctggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggtcttaacc

SEQ ID NO: 670 - DNA, 1405 bp, Ochrobactrum sp.
ccatgcagtcgaacggcagcacggacttcggtctggtggcgagtggcgaacgggtgagtaatgtatcggaacgtgcctagtagcgggggataactacgcgaaagcgtagctaataccgcatacgccctacgggggaaagcaggggatcgcaagaccttgcactattagagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggctaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagctcaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttagtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaattcggatgagatttggaagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgataccata

SEQ ID NO: 671 - DNA, 1388 bp, Bacillus sp.
gaacggcagcacgggtgcttgcacctggtggcgagtggcgaacgggtgagtaatacatcggaacatgtcctgtagtgggggatagcccggcgaaagccggattaataccgcatacgatctacggatgaaagcgggggaccttcgggcctcgcgctatagggttggccgatggctgattagctagttggtggggtaaaggcccaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatcctgagggctaatatccttcggggatgacggtaccggaagaataagcaccggctaactacgtgccagcagccgcggtaatacgtagggtgcgagcgttaatcggaattactgggcgtaaagcgtgcgcaggcggtttgttaagaccgatgtgaaatccccgggctcaacctgggaactgcattggtgactggcaagctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctagagagatctgggagtgctcgaaagagaaccgatacacaggtgctgcatggctgtcgtcagctcgtgtcgtgagatgttgggttaagtcccgcaacgagcgcaacccttgtccttagttgctacgcaagagcactctagggagactgccggtgacaaaccggaggaaggtggggatgacgtcaagtcctcatggcccttatgggtagggcttcacacgtcatacaatggtcggaacagagggtcgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaacctgcaaggagga

SEQ ID NO: 672 - DNA, 1394 bp, Paenibacillus sp.
gaacggcagcacgggtgcttgcacctggtggcgagtggcgaacgggtgagtaatacatcggaacatgtcctgtagtgggggatagcccggcgaaagccggattaataccgcatacgatctacggatgaaagcgggggaccttcgggcctcgcgctatagggttggccgatggctgattagctagttggtggggtaaaggcccaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatcctgagggctaatatccttcggggatgacggtaccggaagaataagcaccggctaactacgtgccagcagccgcggtaatacgtagggtgcgagcgttaatcggaattactgggcgtaaagcgtgcgcaggcggtttgttaagaccgatgtgaaatccccgggctcaacctgggaactgcattggtgactggcaagctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctggagagatctgggagtgctcgaaagagaaccgatacacaggtgctgcatggctgtcgtcagctcgtgtcgtgagatgttgggttaagtcccgcaacgagcgcaacccttgtccttagttgctacgcaagagcactctagggagactgccggtgacaaaccggaggaaggtggggatgacgtcaagtcctcatggcccttatgggtagggcttcacacgtcatacaatggtcggaacagagggtcgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcta

SEQ ID NO: 673 - DNA, 1390 bp, Paenibacillus sp.
agcagtcgaacggcagcacgggtgcttgcacctggtggcgagtggcgaacgggtgagtaatacatcggaacatgtcctgtagtgggggatagcccggcgaaagccggattaataccgcatacgatctacggatgaaagcgggggaccttcgggcctcgcgctatagggttggccgatggctgattagctagttggtggggtaaaggcccaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatcctgagggctaatatccttcggggatgacggtaccggaagaataagcaccggctaactacgtgccagcagccgcggtaatacgtagggtgcgagcgttaatcggaattactgggcgtaaagcgtgcgcaggcggtttgttaagaccgatgtgaaatccccgggctcaacctgggaactgcattggtgactggcaagctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctagagagatctgggagtgctcgaaagagaaccgatacacaggtgctgcatggctgtcgtcagctcgtgtcgtgagatgttgggttaagtcccgcaacgagcgcaacccttgtccttagttgctacgcaagagcactctagggagactgccggtgacaaaccggaggaaggtggggatgacgtcaagtcctcatggcccttatgggtagggcttcacacgtcatacaatggtcggaacagagggtcgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaacctgcaag

SEQ ID NO: 674 - DNA, 1401 bp, Microbacterium sp.
cagtcgaacggcagcacgggtgcttgcacctggtggcgagtggcgaacgggtgagtaatacatcggaacatgtcctgtagtgggggatagcccggcgaaagccggattaataccgcatacgatctacggatgaaagcgggggaccttcgggcctcgcgctatagggttggccgatggctgattagctagttggtggggtaaaggcccaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatcctgagggctaatatccttcggggatgacggtaccggaagaataagcaccggctaactacgtgccagcagccgcggtaatacgtagggtgcgagcgttaatcggaattactgggcgtaaagcgtgcgcaggcggtttgttaagaccgatgtgaaatccccgggctcaacctgggaactgcattggtgactggcaagctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctaccccttgacatggtcggaatcctagagagatctgggagtgctcgaaagagaaccgatacacaggtgctgcatggctgtcgtcagctcgtgtcgtgagatgttgggttaagtcccgcaacgagcgcaacccttgtccttagttgctacgcaagagcactctagggagactgccggtgacaaaccggaggaaggtggggatgacgtcaagtcctcatggcccttatgggtagggcttcacacgtcatacaatggtcggaacagagggtcgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcacc

SEQ ID NO: 675 - DNA, 1403 bp, Ochrobactrum sp.
atgcagtcgaacggcagcacgggtgcttgcacctggtggcgagtggcgaacgggtgagtaatacatcggaacatgtcctgtagtgggggatagcccggcgaaagccggattaataccgcatacgatctacggatgaaagcgggggaccttcgggcctcgcgctatagggttggccgatggctgattagctagttggtggggtaaaggcccaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatcctgagggctaatatccttcggggatgacggtaccggaagaataagcaccggctaactacgtgccagcagccgcggtaatacgtagggtgcgagcgttaatcggaattactgggcgtaaagcgtgcgcaggcggtttgttaagaccgatgtgaaatccccgggctcaacctgggaactgcattggtgactggcaagctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgggtcggaatcctagagagatctgggagtgctcgaaagagaaccgatacacaggtgctgcatggctgtcgtcagctcgtgtcgtgagatgttgggttaagtcccgcaacgagcgcaacccttgtccttagttgctacgcaagagcactctagggagactgccggtgacaaaccggaggaaggtggggatgacgtcaagtcctcatggcccttatgggtagggcttcacacgtcatacaatggtcggaacagagggtcgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcta

SEQ ID NO: 676 - DNA, 1405 bp, Achromobacter sp.
catgcagtcgaacggcagcacgggtgcttgcacctggtggcgagtggcgaacgggtgagtaatacatcggaacatgtcctgtagtgggggatagcccggcgaaagccggattaataccgcatacgatccacggatgaaagcgggggaccttcgggcctcgcgctatagggttggccgatggctgattagctagttggtggggtaaaggcccaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatcctgagggctaatatccttcggggatgacggtaccggaagaataagcaccggctaactacgtgccagcagccgcggtaatacgtagggtgcgagcgttaatcggaattactgggcgtaaagcgtgcgcaggcggtttgttaagaccgatgtgaaatccccgggctcaacctgggaactgcattggtgactggcaagctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctggagagatctgggagtgctcgaaagagaaccgatacacaggtgctgcatggctgtcgtcagctcgtgtcgtgagatgttgggttaagtcccgcaacgagcgcaacccttgtccttagttgctacgcaagagcactctagggagactgccggtgacaaaccggaggaaggtggggatgacgtcaagtcctcatggcccttatgggtagggcttcacacgtcatacaatggtcggaacagagggtcgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtctacc

SEQ ID NO: 677 - DNA, 1334 bp, Bacillus sp.
catagcagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggacgggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggtttacccgaaggcgctgtgctaa

SEQ ID NO: 678 - DNA, 1367 bp, Bacillus sp.
catagcaagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttgggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgaagatgattgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccactatagt

SEQ ID NO: 679 - DNA, 1403 bp, Bacillus sp.
atgcagtcgaacggcagcacggacttcggtctggtggcgagtggcgaacgggtgagtaatgtatcggaacgtgcccagtagcgggggataactacgcgaaagcgtagctaataccgcatacgccctacgggggaaagcaggggatcgtaagaccttgcactattggagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggttaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagcttaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttggtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaatgccgaagagatttggcagtgctcgcatgagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgataccata

SEQ ID NO: 680 - DNA, 1356 bp, Rhodococcus sp.
atagcagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgtccac

SEQ ID NO: 681 - DNA, 1419 bp, Achromobacter sp.
ctacatgcagtcgagcggacagaagggagcttgctcccggatgttagcggcggacgggtgagtaacacgtgggtaacctgcctgtaagactgggataactccgggaaaccggagctaataccggatagttccttgaaccgcatggttcaaggatgaaagacggtttcggctgtcacttacagatggacccgcggcgcattagctagttggtggggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgcgagagtaactgctcgcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaaccctagagatagggctttcccttcggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggctgcaagaccgcaaggtttagccaatcccataaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgcaacacccgaagtcggtgaggtaacctttatggagccagcc

SEQ ID NO: 682 - DNA, 1341 bp, Burkholderia sp.
ttacggggtacacgagcggcgaacgggtgagtaacacgtgggtgatctgccctgcacttcgggataagcctgggaaactgggtctaataccggatatgacctcctatcgcatggtgggtggtggaaagatttatcggtgcaggatgggcccgcggcctatcagcttgttggtggggtaatggcctaccaaggcgacgacgggtagccgacctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggacgaagcgcaagtgacggtacctgcagaagaagcaccggctaactacgtgccagcagccgcggtaatacgtagggtgcaagcgttgtccggaattactgggcgtaaagagttcgtaggcggtttgtcgcgtcgtttgtgaaaaccagcagctcaactgctggcttgcaggcgatacgggcagacttgagtactgcaggggagactggaattcctggtgtagcggtgaaatgcgcagatatcaggaggaacaccggtggcgaaggcgggtctctgggcagtaactgacgctgaggaacgaaagcgtgggtagcgaacaggattagataccctggtagtccacgccgtaaacggtgggcgctaggtgtgggttccttccacggaatccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggtttgacatataccggaaagctgcagagatgtggccccccttgtggtcggtatacaggtggtgcatggctgtcgtcagctcgtgtcgtgagatgttgggttaagtcccgcaacgagcgcaacccctatcttatgttgccagcacgttatggtggggactcgtaagagactgccggggtcaactcggaggaaggtggggacgacgtcaagtcatcatgccccttatgtccagggcttcacacatgctacaatggccagtacagagggctgcgagaccgtgaggtggagcgaatcccttaaagctggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggtc

SEQ ID NO: 683 - DNA, 1391 bp, Burkholderia sp.
cgaacggcagcacggacttcggtctggtggcgagtggcgaacgggtgagtaatgtatcggaacgtgcccagtagcgggggataactacgcgaaagcgtagctaataccgcatacgccctacgggggaaagcaggggatcgcaagaccttgcactattggagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggttaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagcttaactttggaactgcatttttaactaccgggctagagtgtgtcagagggaggtggaattccgcgtgtagcagtgaaatgcgtagatatgcggaggaacaccgatggcgaacgcagcctcctgggataacactgacgctcatgcacgatagcgtggggagcaaacaggattagataccctggtagtccacgccctaaacgatgtcaactagctgttggggccttcgggccttgctagcgcagctaacgcgtgaagttgaccgcctggggagtacggtcgcaagattaatactcaaaggaattgacggggacccgcacaagcggtggatgatgtggattaattcgatgcaacgcgaaaaagcttacctacccttgacatgtctggaattccgaagagatttggcagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgata

SEQ ID NO: 684 - DNA, 1364 bp, Burkholderia sp.
cgatgaacctggagcttgctctgggggattagtggcgaacgggtgagtaacacgtgagcaacctgcccctgactctgggataagcgctggaaacggcgtctaatactggatacgaacaagaatcgcatggttacttgttggaaagattttttggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcggaagcctgatgcagcaacgccgcgtgagggatgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatcccgaggctcaacctcgggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacggaccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaatgggcagcgataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcctaac

SEQ ID NO: 685 - DNA, 1423 bp, Burkholderia sp.
tacatgcagtcgagcggacagaagggagcttgctcccggatgttagcggcggacgggtgagtaacacgtgggtaacctgcctgtaagactgggataactccgggaaaccggagctaataccggatagttccttgaaccgcatggttcaaggatgaaagacggtttcggctgtcacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgcaagagtaactgcttgcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaaccctagagatagggctttcccttcggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggctgcgagaccgcaaggtttagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgcaacacccgaagtcggtgaggtaacctttatggagccagccgccga

SEQ ID NO: 686 - DNA, 1419 bp, Burkholderia sp.
catgcagtcgagcggacagaagggagcttgctcccggatgttagcggcggacgggtgagtaacacgtgggtaacctgcctgtaagactgggataactccgggaaaccggagctaataccggatagttccttgaaccgcatggttcaaggatgaaagacggtttcggctgtcacttacagatggacccgcggcgcattagctagttggtggggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgcgagagtaactgctcgcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagtagcttaccaggtcttgacatcctctgacatccctagagatagggctttcccttcggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggctgcaagaccgcaaggtttagccaatcccataaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgcaacacccgaagtcggtgaggtaacctttatggagccagcctct

SEQ ID NO: 687 - DNA, 1363 bp, Burkholderia sp.
cacatgcagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaacccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggttacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccactata

SEQ ID NO: 688 - DNA, 1353 bp, Ochrobactrum sp.
tgcagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgtcca

SEQ ID NO: 689 - DNA, 1352 bp, Ochrobactrum sp.
tagcagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagcccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaacctgcaaggaggcaggcg

SEQ ID NO: 690 - DNA, 1390 bp, Achromobacter sp.
agtcgacggcagcacggacttcggtctggtggcgagtggcgaacgggtgagtaatgtatcggaacgtgcccagtagcgggggataactacgcgaaagcgtagctaataccgcatacgccctacgggggaaagcaggggatcgtaagaccttgcactattggagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggttaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagcttaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttggtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaatgccgaagagatttggcagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcg

SEQ ID NO: 691 - DNA, 1407 bp, Ochrobactrum sp.
accatgcagtcgaacggcagcacggacttcggtctggtggcgagtggcgaacgggtgagtaatgtatcggaacgtgcccagtagcgggggataactacgcgaaagcgtagctaataccgcatacgccctacgggggaaagcaggggatcgtaagaccttgcactattggagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggttaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagcttaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttggtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaatgccgaagagatttggcagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgataccatag

SEQ ID NO: 692 - DNA, 1393 bp, Bacillus sp.
catgcagtcgaacggtgaacacggagcttgctctgtgggatcagtggcgaacgggtgagtaacacgtgagcaacctgcccctgactctgggataagcgctggaaacggcgtctaatactggatatgtgacgtgatcgcatggtctgcgtctggaaagaatttcggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggacgacggccttcgggttgtaaacctcttttagcagggaagaagcgaaagtgacggtaccctgcagaaaaagcgccggctaactacgtgccagcagccgcggtaatacgtagggcgcaagcgttatccggaattattgggcgtaaagagctcgtaggcggtttgtcgcgtctgctgtgaaatccggaggctcaacctccggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaatagctcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcctaacccttgtggagggagccg

SEQ ID NO: 693 - DNA, 1392 bp, Rhodococcus sp.
catgcagtcgaacggtgaacacggagcttgctctgtgggatcagtggcgaacgggtgagtaacacgtgagcaacctgcccctgactctgggataagcgctggaaacggcgtctaatactggatatgtgacgtgatcgcatggtctgcgtctggaaagaatttcggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggacgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatccggaggctcaacctccggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaagcttaccaaggcttgacatatacgagaacgggccagaaatggtcaactctttggacactcgtaaacaggacgtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcctaacccttgtggagggagccg

SEQ ID NO: 694 - DNA, 1361 bp, Achromobacter sp.
atgcagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccactatagt

SEQ ID NO: 695 - DNA, 1403 bp, Microbacterium sp.
catgcagtcgaacggcagcacggacttcggtctggtggcgagtggcgaacgggtgagtaatgtatcggaacgtgcctagtagcgggggataactacgcgaaagcgtagctaataccgcatacgccctacgggggaaagcaggggatcgcaagaccttgcactattagagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggctaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagctcaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttagtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaattcctgaagagatttgggaagtgctcgcaagagaatcgggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgatac

SEQ ID NO: 696 - DNA, 1430 bp, Bacillus sp.
agtcgagcggagtcttggttggaagcttgcttccaacttggcttagcggcggacgggtgagtaacacgtaggcaacctgcccctaagactgggataactaccggaaacggtagctaataccggataatctctttcctctcctgagggaagaatgaaaggcggagcaatctgccacttggggatgggcctgcggcgcattagctagttggcggggtaacggcccaccaaggcgacgatgcgtagccgacctgagagggtgaacggccacactgggactgagacacggcccagactcctacgggaggcagcagtagggaatcttccgcaatgggcgacagcctgacggagcaacgccgcgtgagtgatgaaggttttcggatcgtaaagctctgttgccagggaagaacgtccggtagagtaactgttaccggagtgacggtacctgagaagaaagccccggctaactacgtgccagcagccgcggtaatacgtagggggcaagcgttgtccgggaattattgggcgtaaagcgcgcgcaggcggctatttaagtctggtgtttaaaccttgggctcaacctggggtcgcactggaaactgggtggcttgagtacagaagaggaaagtggaattccacgtgtagcggtgaaatgcgtagagatgtggaggaacaccagtggcgaaggcgactttctgggctgtaactgacgctgaggcgcgaaagcgtggggagcaaacaggattagataccctggtagtccacgccgtaaacgatgagtgctaggtgttaggggtttcgatacccttggtgccgaagttaacacagtaagcactccgcctggggagtacggtcgcaagactgaaactcaaaggaattgacggggacccgcacaagcagtggagtatgtggtttaattcgaagcaacgcgaagaacctttaccaggtcttgacatccaactaacgaagcagagatgcatcaggtgcccttcggggaaagttgagacaggtggtgcatggttgtcgtcagctcgtgtcgtgagatgttgggttaagtcccgcaacgagcgcaacccttgactttagttgccagcaggttgagctgggcactctagagtgactgccggtgacaaaccggaggaaggtggggatgacgtcaaatcatcatgccccttatgacctgggctacacacgtactacaatggccggtacaacgggaagcgaagccgcgaggtggagccaatcccagcaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaacccgcaagggagccagcctccg

SEQ ID NO: 697 - DNA, 1404 bp, Bacillus sp.
ccatgcagtcgaacggcagcacggacttcggtctggtggcgagtggcgaacgggtgagtaatgtatcggaacgtgcctagtagcgggggataactacgcgaaagcgtagctaataccgcatacgccctacgggggaaagcaggggatcgcaagaccttgcactattagagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggctaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagctcaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttagtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaattcggatctctttaggaagtgctcgcaagagaacccgtacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgataccag

SEQ ID NO: 698 - DNA, 1409 bp, Ochrobactrum sp.
cagtcgagcgatggattgagagcttgctctcaagaagttagcggcggacgggtgagtaacacgtgggtaacctgcccataagactgggataactccgggaaaccggggctaataccggataatattttgaactgcatggttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccgggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgaaaaccctagagatagggcttctccttcgggagcagagtgacaggtggtgcatggttgtcgtcagctcgtgtcgtgagatgttgggttaagtcccgcaacgagcgcaacccttgatcttagttgccatcattaagttgggcactctaaggtgactgccggtgacaaaccggaggaaggtggggatgacgtcaaatcatcatgccccttatgacctgggctacacacgtgctacaatggacggtacaaagagctgcaagaccgcgaggtggagctaatctcataaaaccgttctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaacctttatggag

SEQ ID NO: 699 - DNA, 1359 bp, Ochrobactrum sp.
cacatgcagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccact

SEQ ID NO: 700 - DNA, 1438 bp, Ochrobactrum sp.
actaatacatgcaagtcgagcggacttgatgagaagcttgcttctctgatgcgttagcggcggacgggtgagtaacacgtaggcaacctgccctcaagtttgggacaactaccggaaacggtagctaataccgaatagttgtttccttcgcctgaaggaaactggaaagacggagcaatctgtcacttggggatgggcctgcggcgcattagctagttggtggggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctccaaggtgacggtacctgagaagaaagccccggctaactacgtgccagcagccgcggtaatacgtagggggcaagcgttgtccggaattattgggcgtaaagcgcgcgcaggcggtcatttaagtctggtgtttaatcccggggctcaaccccggatcgcactggaaactgggtgacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgagtgctaggtgttaggggtttcgatacccttggtgccgaagttaacacattaagcactccgcctggggagtacggtcgcaagactgaaactcaaaggaattgacggggacccgcacaagcagtgggagtatgtggtttaattcgaagcaacgcgaagaaccttaccaggtcttgacatccgaatgaccggtgcagagatgtaccttttcttcggaacattcaagacaggtggtgcatggttgtcgtcagctcgtgtcgtgagatgttgggttaagtcccgcaacgagcgcaacccttatatttagttgccagcacttcgggtgggcactctagatagactgccggtgacaaaccggaggaaggtggggatgacgtcaaatcatcatgccccttatgacctgggctacacacgtactacaatggccggtacaacgggctgcgaaatcgcgagatggagccaatcccaacaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaaccgcaaggagccagccgccgatg

SEQ ID NO: 701 - DNA, 1398 bp, Achromobacter sp.
cacatgcagtcgaacggtgaacacggagcttgctctgtgggatcagtggcgaacgggtgagtaacacgtgagcaacctgcccctgactctgggataagcgctggaaacggcgtctaatactggatatgtgacgtgatcgcatggtctgcgtctggaaagaatttcggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggacgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatccggaggctcaacctccggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaagcttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcctaacccttgtggagggagccgtcga

SEQ ID NO: 702 - DNA, 1357 bp, Achromobacter sp.
atgcagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccacta

SEQ ID NO: 703 - DNA, 1422 bp, Microbacterium sp.
aatacatgcagtcgagcggacagaagggagcttgctcccggatgttagcggcggacgggtgagtaacacgtgggtaacctgcctgtaagactgggataactccgggaaaccggagctaataccggatagttccttgaaccgcatggttcaaggatgaaagacggtttcggctgtcacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgcaagagtaactgcttgcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggatttgacgggggcccgcacaagcggtggagcatgtggtttaattcgaagcaacgcgaagaaccttaccaggtcttgacatcctctgacaaccctagagatagggctttcccttcggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggctgcgagaccgcaaggtttagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgcaacacccgaagtcggtgaggtaacctttatggagccagcctc

SEQ ID NO: 704 - DNA, 1409 bp, Microbacterium sp.
taccatgcagtcgaacggcagcacggacttcggtctggtggcgagtggcgaacgggtgagtaatgtatcggaacgtgcccagtagcgggggataactacgcgaaagcgtagctaataccgcatacgccctacgggggaaagcaggggatcgtaagaccttgcactattggagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggttaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagcttaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttggtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaatgccgaagagatttggcagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgataccactag

SEQ ID NO: 705 - DNA, 1415 bp, Ochrobactrum sp.
gcagtcggacggtagcacagaggagcttgctcctcgggtgacgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagcttgtaggcggggtaacggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtggtgaggttaataacctcatcaattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtgggtttaattcgatgcaacgcgaagaaccttacctactcttgacatccagcgaactttccagagatgggattggtgccttcgggaacgctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccctcgggagggcgctaccatag

SEQ ID NO: 706 - DNA, 1398 bp, Achromobacter sp.
caacagaggagcttgctcctcgggtgacgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagcttgtaggcggggtaacggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtggtgaggttaataacctcatcaattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagcgaactttccagagatggattggtgccttcgggaacgctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccctcgggagggcgctaccata

SEQ ID NO: 707 - DNA, 1415 bp, Paenibacillus sp.
atgcagtcggacggtagcacagaggagcttgctcctcgggtgacgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagcttgtaggcggggtaacggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgctgaggttaataacctcatcaattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagcgaactttccagagatggattggtgccttcgggaacgctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccctcgggagggcgctaccatag

SEQ ID NO: 708 - DNA, 1421 bp, Achromobacter sp.
gcaagtcgagcggacttaaaaagcttgctttttaagttagcggcggacgggtgagtaacacgtgggcaacctgcctgtaagactgggataacttcgggaaaccggagctaataccggataatccttttctactcatgtagaaaagctgaaagacggtttacgctgtcacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtacgagagtaactgctcgtaccttgacggtacctaaccagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactgggggacttgagtgcagaagagaagagtggaattccacgtgtagcggtgaaatgcgtagagatgtggaggaacaccagtggcgaaggcgactctttggtctgtaactgacgctgaggcgcgaaagcgtggggagcaaacaggattagataccctggtagtccacgccgtaaacgatgagtgctaagtgttagagggtttccgccctttagtgctgcagcaaacgcattaagcactccgcctggggagtacggccgcaaggctgaaactcaaaggaattgacgggggcccgcacaagcggtggagcatgtggtttaattcgaagcaacgcgaagaaccttaccaggtcttgacatctcctgacaatcctagagataggacgttccccttcgggggacaggatgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatggtacaaagggcagcaaaaccgcgaggtcgagccaatcccataaaaccattctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaacccttctgggagccagccgcctat

SEQ ID NO: 709 - DNA, 1416 bp, Bacillus sp.
cacatgcagtcgaacggtagcacagagagcttgctctcgggtgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgttgtggttaataaccgcagcaattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccatat

SEQ ID NO: 710 - DNA, 1403 bp, Ochrobactrum sp.
accatgcagtcgacggcagcacgggtgcttgcacctggtggcgagtggcgaacgggtgagtaatacatcggaacatgtcctgtagtgggggatagcccggcgaaagccggattaataccgcatacgatctacggatgaaagcgggggaccttcgggcctcgcgctatagggttggccgatggctgattagctagttggtggggtaaaggcccaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatcctgagggctaatatccttcggggatgacggtaccggaagaataagcaccggctaactacgtgccagcagccgcggtaatacgtagggtgcgagcgttaatcggaattactgggcgtaaagcgtgcgcaggcggtttgttaagaccgatgtgaaatccccgggctcaacctgggaactgcattggtgactggcaagctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctggagagatctgggagtgctcgaaagagaaccgatacacaggtgctgcatggctgtcgtcagctcgtgtcgtgagatgttgggttaagtcccgcaacgagcgcaacccttgtccttagttgctacgcaagagcactctagggagactgccggtgacaaaccggaggaaggtggggatgacgtcaagtcctcatggcccttatgggtagggcttcacacgtcatacaatggtcggaacagagggtcgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtca

SEQ ID NO: 711 - DNA, 1401 bp, Paenibacillus sp.
atgcagtcgacggcagcacgggtgcttgcacctggtggcgagtggcgaacgggtgagtaatacatcggaacatgtcctgtagtgggggatagcccggcgaaagccggattaataccgcatacgatctacggatgaaagcgggggaccttcgggcctcgcgctatagggttggccgatggctgattagctagttggtggggtaaaggcccaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatcctgagggctaatatccttcggggatgacggtaccggaagaataagcaccggctaactacgtgccagcagccgcggtaatacgtagggtgcgagcgttaatcggaattactgggcgtaaagcgtgcgcaggcggtttgttaagaccgatgtgaaatccccgggctcaacctgggaactgcattggtgactggcaagctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctggagagatctgggagtgctcgaaagagaaccgatacacaggtgctgcatggctgtcgtcagctcgtgtcgtgagatgttgggttaagtcccgcaacgagcgcaacccttgtccttagttgctacgcaagagcactctagggagactgccggtgacaaaccggaggaaggtggggatgacgtcaagtcctcatggcccttatgggtagggcttcacacgtcatacaatggtcggaacagagggtcgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcta

SEQ ID NO: 712 - DNA, 1406 bp, Microbacterium sp.
cacatgcagtcgaacggcagcacgggtgcttgcacctggtggcgagtggcgaacgggtgagtaatacatcggaacatgtcctgtagtgggggatagcccggcgaaagccggattaataccgcatacgatctacggatgaaagcgggggaccttcgggcctcgcgctatagggttggccgatggctgattagctagttggtggggtaaaggcccaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatcctgagggctaatatccttcggggatgacggtaccggaagaataagcaccggctaactacgtgccagcagccgcggtaatacgtagggtgcgagcgttaatcggaattactgggcgtaaagcgtgcgcaggcggtttgttaagaccgatgtgaaatccccgggctcaacctgggaactgcattggtgactggcaagctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctagagagatctgggagtgctcgaaagagaaccgatacacaggtgctgcatggctgtcgtcagctcgtgtcgtgagatgttgggttaagtcccgcaacgagcgcaacccttgtccttagttgctacgcaagagcactctagggagactgccggtgacaaaccggaggaaggtggggatgacgtcaagtcctcatggcccttatgggtagggcttcacacgtcatacaatggtcggaacagagggtcgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcacc

SEQ ID NO: 713 - DNA, 1382 bp, Ochrobactrum sp.
tgtagtcgacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggtcgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaagg

SEQ ID NO: 714 - DNA, 1407 bp, Bacillus sp.
tcgacggtacaggaagcagcttgctgcttcgctgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgcggttaataaccgcgtcgattgacgttacccgcagaagaagcaccggctaactccgtgcccagcagccgcggtaatacggagggtgcaagcgttaatcggaattactgggcgtaaagcgcacgcaggcggtctgtcaagtcggatgtgaaatccccgggctcaacctgggaactgcatccgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtgggggagcaaacaggattagataccctggtagtccacgccgtaaacgatgtcgacttggaggttgtgcccttgaggcgtggcttccggagctaacgcgttaagtcgaccgcctggggagtacggccgcaagggttaaaactcaaatgaattgacgggggcccgcacaagcggtggagcatgtggtttaattcgatgcaacgcgaagaaccttacctggtcttgacatccacagaacttggcagagatgcaaaggtgccttcgggaactgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgatctcgcgagagccagcggacctcataaagtgcgtcgtagtccggattggagtctgcaactcgactccatgaagtcggaatcgctagtaatcgtgaatcagaatgtcacggtgaatacgttcccgggccttgtacacaccgcccgtcacaccatgggagtgggttgcaaaagaagtaggtagcttaaccttcgggagggcgctactc

SEQ ID NO: 715 - DNA, 1415 bp, Achromobacter sp.
accatgcagtcgacggtagcacagagagcttgctctcgggtgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgttgtggttaataaccgcagcaattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatggtttggtgccttcgggaactctgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgagtagggctacacacgtgctacaatggcgcatacaaagagaagcgaactcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccatat

SEQ ID NO: 716 - DNA, 1399 bp, Enterobacteriaceae
caagtcgacggcagcacgggtgcttgcacctggtggcgagtggcgaacgggtgagtaatacatcggaacatgtcctgtagtgggggatagcccggcgaaagccggattaataccgcatacgatctacggatgaaagcgggggaccttcgggcctcgcgctatagggttggccgatggctgattagctagttggtggggtaaaggcccaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatcctgagggctaatatccttcggggatgacggtaccggaagaataagcaccggctaactacgtgccagcagccgcggtaatacgtagggtgcgagcgttaatcggaattactgggcgtaaagcgtgcgcaggcggtttgttaagaccgatgtgaaatccccgggctcaacctgggaactgcattggtgactggcaagctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctagagagatctgggagtgctcgaaagagaaccgatacacaggtgctgcatggctgtcgtcagctcgtgtcgtgagatgttgggttaagtcccgcaacgagcgcaacccttgtccttagttgctacgcaagagcactctagggagactgccggtgacaaaccggaggaaggtggggatgacgtcaagtcctcatggcccttatgggtagggcttcacacgtcatacaatggtcggaacagagggtcgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcac

SEQ ID NO: 717 - DNA, 1412 bp, Enterobacteriaceae
catgcagtcggacggtagcacagagagcttgctctcgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaatggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgcggttaataaccgcgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtacagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagcgaacggagcagagatgccccggtgccttcgggaacgctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgctaccat

SEQ ID NO: 718 - DNA, 1393 bp, Pantoea sp.
atgcaagtcgaacgatgatcaggagcttgctcctgtgattagtggcgaacgggtgagtaacacgtgagtaacctgcccctgactctgggataagcgttggaaacgacgtctaatactggatatgatcactggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccgggaaatgggccagagatggtcgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagccgt

SEQ ID NO: 719 - DNA, 1373 bp, Bacillus sp.
agaggagcttgctcctcgattcagcggcggacgggcgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccttcgggtcgtaaagcactttaagttgggaggaagggctcatagcgaatacctgtgagttttgacgttaccaacagaataagcaccggctaacttcgtgccagcagccgcggtaatacgaagggtgcaagcgttaatcggaattactgggcgtaaagcgcgcgtaggtggcttgataagttggatgtgaaatccccgggctcaacctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaacta

SEQ ID NO: 720 - DNA, 1389 bp, Enterobacter sp.
cagcagtcgacgatgaagcccagcttgctgggtggattagtggcgaacgggtgagtaacacgtgagtaacctgcccctgactctgggataagcgttggaaacgacgtctaatactggatatgactactggtcgcatggcctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggtcgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagccga

SEQ ID NO: 721 - DNA, 1416 bp, Burkholderia sp.
acatgcagtcggacggtagcacagaggagcttgctcctcgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaacggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcagtgaggttaataaccttactgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaacctccgggagggcgcttaccat

SEQ ID NO: 722 - DNA, 1405 bp, Burkholderia sp.
cacatgcagtcgagcggatgagaggagcttgctcctcgattcagcggcggacgggtgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccttcgggtcgtaaagcactttaagttgggaggaagggctcatagcgaatacctgtgagttttgacgttaccaacagaataagcaccggctaacttcgtgccagcagccgcggtaatacgaagggtgcaagcgttaatcggaattactgggcgtaaagcgcgcgtaggtggcttgataagttggatgtgaaatccccgggctcaacctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccttcgggaggacgg

SEQ ID NO: 723 - DNA, 1410 bp, Burkholderia sp.
tgcagtcgagcggatgagaggagcttgctcttcgattcagcggcggacgggtgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccttcgggtcgtaaagcactttaagttgggaggaagggctcatagcgaatacctgtgagttttgacgttaccaacagaataagcaccggctaacttcgtgccagcagccgcggtaatacgaagggtgcaagcgttaatcggaattactgggcgtaaagcgcgcgtaggtggcttgataagttggatgtgaaatccccgggctcaacctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccctcgggaggacggtaccactag

SEQ ID NO: 724 - DNA, 1403 bp, Curtobacterium sp.
atgcagtcgagcggatgagaggagcttgctcctcgattcagcggcggacgggtgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccttcgggtcgtaaagcactttaagttgggaggaagggctcacagcgaatacctgtgagttttgacgttaccaacagaataagcaccggctaacttcgtgccagcagccgcggtaatacgaagggtgcaagcgttaatcggaattactgggcgtaaagcgcgcgtaggtggcttgataagttggatgtgaaatccccgggctcaaccctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccctcgggaggacgg

SEQ ID NO: 725 - DNA, 1415 bp, Enterobacter sp.
catgcagtcggacggtagcacagaggagcttgctcctcgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaatggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataacctcaccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatggtttggtgccttcgggaactctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgctacccat

SEQ ID NO: 726 - DNA, 1413 bp, Enterobacter sp.
acacatgcagtcgagcggatgatgggagcttgctcctggattcagcggcggacgggtgagtaatgcctaggaatctgcctggtagtgggggacaacgtttcgaaaggaacgctaataccgcatacgtcctacgggagaaagcaggggaccttcgggccttgcgctatcagatgagcctaggtcggattagcttgttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggttgtagattaatactctgcaattttgacgttaccgacagaataagcaccggctaactctgtgccagcagccgcggtaatacagagggtgcaagcgttaatcggaattactgggcgtaaagcgcgcgtaggtggtttgttaagttggatgtgaaagccccgggctcaacctgggaactgcatccaaaactggcaagctagagtacggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttggaatccttgagattttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatgcagagaactttccagagatggattggtgccttcgggaactctgacacaggtgctgcatggctgtcgtcagctcgtgtcgtgagatgttgggttaagtcccgtaacgagcgcaacccttgtccttagttaccagcacgttaaggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatctcacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggtaccacg

SEQ ID NO: 727 - DNA, 1417 bp, Burkholderia sp.
atgcaagtcgagcggatgaggggagcttgctcctcgattcagcggcggacgggtgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccctcgggtcgtaaagcactttaagttgggaggaagggctcatagcgaatacctgtgagttttgacgttaccaacagaataagcaccggctaacttcgtgccagcagccgcggtaatacgaagggtgcaagcgttaatcggaattactgggcgtaaagcgcgcgtaggtggcttgataagttggatgtgaaatccccgggctcaacctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctgggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccttcgggaggacggtaccacggagtat

SEQ ID NO: 728 - DNA, 1337 bp, Erwinia sp.
attgctgggtggattagtggcgaacgggcgaaaaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagcc

SEQ ID NO: 729 - DNA, 1390 bp, Curtobacterium sp.
acatgcaagtcgaacgatgatgcccagcttgctgggtggattagtggcgaacgggtgagtaacacgtgagtaacctgcccctgactctgggataagcgttggaaacgacgtctaatactggatatgactactggtcgcatggcctggtggtggaaagattctttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggtcgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagc

SEQ ID NO: 730 - DNA, 1397 bp, Pseudomonas sp.
taccatgcagtcgaacgatgatcaggagcttgctcttgtgattagtggcgaacgggtgagtaacacgtgagtaacctgcccctgactctgggataagcgttggaaacgacgtctaatactggataggactactggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgaaagtgacggtacctgcagaaaaagcaccggctaactacgtgcccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcatggggagcgaacaggattagataccctggtagtccatgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggtcgcccccttgtcgtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagccgtcg

SEQ ID NO: 731 - DNA, 1398 bp, Curtobacterium sp.
tacacatgcagtcgaacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaagggcttgacatacaccgggaaacggccagagatggatcgccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagccgtc

SEQ ID NO: 732 - DNA, 1401 bp, Enterobacteriaceae
ttaccatgcagtcgaacggtgaagccaagcttgcttggtggatcagtggcgaacgggtgagtaacacgtgagcaacctgccctggactctgggataagcgctggaaacggcgtctaatactggatatgagacgtgatcgcatggtcgtgtttggaaagatttttcggtctgggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatcccgaggctcaacctcgggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggaccattccacggtttccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttggacactcgtaaacaggtgggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcccaacccttgtggagggagccgtcgaat

SEQ ID NO: 733 - DNA, 1393 bp, Pseudomonas sp.
cacatgcagtcgaacgatgatcaggagcttgctcctgtgattagtggcgaacgggtgagtaacacgtgagtaacctgcccctgactctgggataagcgttggaaacgacgtctaatactggatacgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagccgt

SEQ ID NO: 734 - DNA, 1428 bp, Pseudomonas sp.
tatacatgcagtcgagcggacagatgggagcttgctccctgatgttagcggcggacgggtgagtaacacgtgggtaacctgcctgtaagactgggataactccgggaaaccggggctaataccggatggttgtctgaaccgcatggttcagacataaaaggtggcttcggctaccacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgccgttcaaatagggcggcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccgaag

SEQ ID NO: 735 - DNA, 1426 bp, Pseudomonas sp.
catgcaagtcgagcggacagatgggagcttgctccctgatgttagcggcggacgggtgagtaacacgtgggtaacctgcctgtaagactgggataactccgggaaaccggggctaataccggatggttgtctgaaccgcatggttcagacataaaaggtggcttcggctaccacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgccgttcaaatagggcggcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccgaatg

SEQ ID NO: 736 - DNA, 1392 bp, Enterobacteriaceae
tcgagcggatgagaggagcttgctcttcgattcagcggcggacgggtgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccctcgggtcgtaaagcactttaagttgggaggaagggctcatagcgaatacctgtgagttttgacgttaccaacagaataagcaccggctaacttcgtgccagcagccgcggtaatacgaagggtgcaagcgttaatcggaattactgggcgtaaagcgcgcgtaggtggcttgataagttggatgtgaaatccccgggctcaacctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaacctcgggagga

SEQ ID NO: 737 - DNA, 1390 bp, Pseudomonas sp.
catgcagtcgacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagccgt

SEQ ID NO: 738 - DNA, 1396 bp, Pseudomonas sp.
cacatgcagtcggacggtagcacagagagagcttgctccttgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaatggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgcggttaataaccgcgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtgggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagctta

SEQ ID NO: 739 - DNA, 1365 bp, Curtobacterium sp.
cacatgcagtcgaacgcatcgcaagatgagtggcagacgggtgagtaacgcgtgggaacatacccttttctacggaatagctctgggaaactggaattaataccgtatacgccctacgggggaaagatttatcggggaaggattggcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctctttcaccgatgaagataatgacggtagtcggagaagaagccccggctaacttcgtgccagcagccgcggtaatacgaagggggctagcgttgttcggaattactgggcgtaaagcgcacgtaggcggatatttaagtcaggggtgaaatcccagagctcaactctggaactgcctttgatactgggtatcttgagtatggaagaggtaagtggaattgcgagtgtagaggtgaaattcgtagatattcgcaggaacaccagtggcgaaggcggcttactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagctcttgacattcggggtatggtcattggagacgatgaccttcagttcggctggcccctagaacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagacagcgatgtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttttacccgaaggcgctgcgctaaccgcaagggggcaggcgaccactgta

SEQ ID NO: 740 - DNA, 1413 bp, Curtobacterium sp.
tgcagtcgaacggtaacaggaagcagcttgctgcttcgctgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgtggttaataaccgcgtcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaaccctgggaactgcatccgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacagaacttgccagagatgcgttggtgccttcgggtactgtgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgaccagggctacacacgtgctacaatggcgcatacaaagagaagcaatctcgcgagagctagcggacctcataaagtgcgtcgtagtccggattggagtctgcaactcgactccatgaagtcggaatcgctagtaatcgtgaatcagaatgtcacggtgaatacgttcccgggccttgtacacaccgcccgtcacaccatgggagtgggttgcaaaagaagtaggtagcttaaccttcgggagggcgctaccac

SEQ ID NO: 741 - DNA, 1369 bp, Curtobacterium sp.
tcgacgatgatgcccagcttgctgggtggattagtggcgaacgggtgagtaacacgtgagtaacctgcccctgactctgggataagcgttggaaacgacgtctaatactggatacgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggtcgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaaccctg

SEQ ID NO: 742 - DNA, 1385 bp, Curtobacterium sp.
cagtcgacgatgatgcccagcttgctgggtggattagtggcgaacgggtgagtaacacgtgagtaacctgcccctgactctgggataagcgttggaaacgacgtctaatactggatacgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaacgcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggtcgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagcct

SEQ ID NO: 743 - DNA, 1400 bp, Microbacterium sp.
acatgcaagtcgaacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgcccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagccgtcgaata

SEQ ID NO: 744 - DNA, 1413 bp, Curtobacterium sp.
agtcgaacggcagcacagaagagcttgctctttgggtggcgagtggcggacgggtgagtaatgtctgggaaactgcccgatggagggggataactactggaaacggtagctaataccgcataacgtcgcgagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataaccttgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaaggcggccccctgggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccatag

SEQ ID NO: 745 - DNA, 1395 bp, Bacillus sp.
ccatgcagtcgaacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagccgtcga

SEQ ID NO: 746 - DNA, 1355 bp, Bacillus sp.
agcagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgtccact

SEQ ID NO: 747 - DNA, 1394 bp, Pseudomonas sp.
acatgcagtcgaacgatgatgcccagcttgctgggtggattagtggcgaacgggtcgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagccgtc

SEQ ID NO: 748 - DNA, 1356 bp, Curtobacterium sp.
atgcagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccact

SEQ ID NO: 749 - DNA, 1386 bp, Erwinia sp.
tagcagtcgagcggtaaggcctttcggggtacacgagcggcgaacgggtgagtaacacgtgggtgatctgccctgcacttcgggataagcctgggaaactgggtctaataccggatatgacctcctatcgcatggtgggtggtggaaagatttatcggtgcaggatgggcccgcggcctatcagcttgttggtggggtaatggcctaccaaggcgacgacgggtagccgacctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggacgaagcgcaagtgacggtacctgcagaagaagcaccggctaactacgtgccagcagccgcggtaatacgtagggtgcaagcgttgtccggaattactgggcgtaaagagttcgtaggcggtttgtcgcgtcgtttgtgaaaaccagcagctcaactgctggcttgcaggcgatacgggcagacttgagtactgcaggggagactggaattcctggtgtagcggtgaaatgcgcagatatcaggaggaacaccggtggcgaaggcgggtctctgggcagtaactgacgctgaggaacgaaagcgtgggtagcgaacaggattagataccctggtagttcacgccgtaaacggtgggcgctaggtgtgggttccttccacggaatccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggtttgacatataccggaaagctgcagagatgtggccccccttgtggtcggtatacaggtggtgcatggctgtcgtcagctcgtgtcgtgagatgttgggttaagtcccgcaacgagcgcaacccctatcttatgttgccagcacgttatggtggggactcgtaagagactgccggggtcaactcggaggaaggtggggacgacgtcaagtcatcatgccccttatgtccagggcttcacacatgctacaatggccagtacagagggctgcgagaccgtgaggtggagcgaatcccttaaagctggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggcttaaccccttgtgggagggagccta

SEQ ID NO: 750 - DNA, 1357 bp, Agrobacterium sp.
acatagcagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgtcca

SEQ ID NO: 751 - DNA, 1397 bp, Enterobacter sp.
catgcagtcgaacggtgaacacggagcttgctctgtgggatcagtggcgaacgggtgagtaacacgtgagcaacctgcccctgactctgggataagcgctggaaacggcgtctaatactggatatgtgacgtgatcgcatggtctgcgtctggaaagaatttcggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggacgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatccggaggctcaacctccggcctgcagtgggtacgggcagactagagtgcggtaggggagattggaattcctggtgtagcgatggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcctaacccttgtggagggagccgtcgaa

SEQ ID NO: 752 - DNA, 1406 bp, Curtobacterium sp.
ccatgcaagtcgaacggcagcacggacttcggtctggtggcgagtggcgaacgggtgagtaatgtatcggaacgtgcctagtagcgggggataactacgcgaaagcgtagctaataccgcatacgccctacgggggaaagcaggggatcgcaagaccttgcactattagagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggctaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagctcaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttagtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaattccgaagagatttggaagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgataccata

SEQ ID NO: 753 - DNA, 1396 bp, Curtobacterium sp.
catgcagtcgaacggtgaacacggagcttgctctgtgggatcagtggcgaacgggtgagtaacacgtgagcaacctgcccctgactctgggataagcgctggaaacggcgtctaatactggatatgtgacgtgatcgcatggtctgcgtctggaaagaatttcggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggacgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatccggaggctcaacctccggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcctaacccttgtggagggagccgtcga

SEQ ID NO: 754 - DNA, 1410 bp, Curtobacterium sp.
taccatgcaagtcgaacggcagcacggacttcggtctggtggcgagtggcgaacgggtgagtaatgtatcggaacgtgcccagtagcgggggataactacgcgaaagcgtagctaataccgcatacgccctacgggggaaagcaggggatcgtaagaccttgcactattggagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggttaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagcttaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttggtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaatgccgaagagatttggcagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgataccactag

SEQ ID NO: 755 - DNA, 1387 bp, Erwinia sp.
atgcagtcgagcggtaaggcctttcggggtacacgagcggcgaacgggtgagtaacacgtgggtgatctgccctgcacttcgggataagcctgggaaactgggtctaataccggatatgacctcctatcgcatggtgggtggtggaaagatttatcggtgcaggatgggcccgcggcctatcagcttgttggtggggtaatggcctaccaaggcgacgacgggtagccgacctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggacgaagcgcaagtgacggtacctgcagaagaagcaccggctaactacgtgccagcagccgcggtaatacgtagggtgcaagcgttgtccggaattactgggcgtaaagagttcgtaggcggtttgtcgcgtcgtttgtgaaaaccagcagctcaactgctggcttgcaggcgatacgggcagacttgagtactgcaggggagactggaattcctggtgtagcggtgaaatgcgcagatatcaggaggaacaccggtggcgaaggcgggtctctgggcagtaactgacgctgaggaacgaaagcgtgggtagcgaacaggattagataccctggtagtccacgccgtaaacggtgggcgctaggtgtgggttccttccacggaatccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggtttgacatataccggaaagctgcagagatgtggccccccttgtggtcggtatacaggtggtgcatggctgtcgtcagctcgtgtcgtgagatgttgggttaagtcccgcaacgagcgcaacccctatcttatgttgccagcacgttatggtggggactcgtaagagactgccggggtcaactcggaggaaggtggggacgacgtcaagtcatcatgccccttatgtccagggcttcacacatgctacaatggccagtacagagggctgcgagaccgtgaggtggagcgaatcccttaaagctggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggcttaaccccttgtgggagggagcctac

SEQ ID NO: 756 - DNA, 1351 bp, Curtobacterium sp.
aagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgacca

SEQ ID NO: 757 - DNA, 1407 bp, Ochrobactrum sp.
accatgcagtcgaacggcagcacggacttcggtctggtggcgagtggcgaacgggtgagtaatgtatcggaacgtgcccagtagcgggggataactacgcgaaagcgtagctaataccgcatacgccctacgggggaaagcaggggatcgtaagaccttgcactattggagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggttaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagcttaactttggaactgcatttttaactaccgggctagagtgtgtcagagggaggtggaattccgcgtgtagcagtgaaatgcgtagatatgcggaggaacaccgatggcgaaaggcagcctcctgggataacactgacgctcatgcacgaaagcgtggggagcaaacaggattagataccctggtagtccacgccctaaacgatgtcaactagctgttggggccttcgggccttggtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaatgccgaagagatttggcagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgataccata

SEQ ID NO: 758 - DNA, 1409 bp, Curtobacterium sp.
accatgcaagtcgaacggcagcacggacttcggtctggtggcgagtggcgaacgggtgagtaatgtatcggaacgtgcctagtagcgggggataactacgcgaaagcgtagctaataccgcatacgccctacgggggaaagcaggggatcgcaagaccttgcactattagagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggctaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagctcaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcatacaggattagataccctggtagtccacgccctaaacgatgtcaactagctgttggggccttcgggccttagtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaattccgaagagatttggaagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgataccactgt

SEQ ID NO: 759 - DNA, 1393 bp, Ochrobactrum sp.
cacatgcagtcgagcggtaaggcctttcggggtacacgagcggcgaacgggtgagtaacacgtgggtgatctgccctgcacttcgggataagcctgggaaactgggtctaataccggatatgacctcctatcgcatggtgggtggtggaaagatttatcggtgcaggatgggcccgcggcctatcagcttgttggtggggtaatggcctaccaaggcgacgacgggtagccgacctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggacgaagcgcaagtgacggtacctgcagaagaagcaccggctaactacgtgccagcagccgcggtaatacgtagggtgcaagcgttgtccggaattactgggcgtaaagagttcgtaggcggtttgtcgcgtcgtttgtgaaaaccagcagctcaactgctggcttgcaggcgatacgggcagacttgagtactgcaggggagactggaattcctggtgtagcggtgaaatgcgcagatatcaggaggaacaccggtggcgaaggcgggtctctgggcagtaactgacgctgaggaacgaaagcgtgggtagcgaacaggattagataccctggtagtccacgccgtaaacggtgggcgctaggtgtgggttccttccacggaatccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggtttgacatataccggaaagctgcagagatgtggccccccttgtggtcggtatacaggtggtgcatggctgtcgtcagctcgtgtcgtgagatgttgggttaagtcccgcaacgagcgcaacccctatcttatgttgccagcacgttatggtggggactcgtaagagactgccggggtcaactcggaggaaggtggggacgacgtcaagtcatcatgccccttatgtccagggcttcacacatgctacaatggccagtacagagggctgcgagaccgtgaggtggagcgaatcccttaaagctggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggcttaaccccttgtgggagggagccgtcgaa

SEQ ID NO: 760 - DNA, 1397 bp, Rhodococcus sp.
ccatgcaagtcgaacgatgaagcggtgcttgcaccgtggattagtggcgaacgggtgagtaacacgtgagcaacctgccctggactctgggataagcgctggaaacggtgtctaatactggatatgagctctcatcgcatggtgggggttggaaagattttttggtctgggatgggctcgcggcctatcagcttgttggtgaggtaatggcttaccaaggcgtcgacgggtagccggcctgagagggtgaccggccacactgggactgagacacggcccagactcctacgggaggcagcagtggggaatattgcacaatgggcggaagcctgatgcagcaacgccgcgtgagggatgacggccttcgggttgtaaacctcttttagcagggaagaagcgtgagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatcccgaggctcaacctcgggtctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggaccattccacggtttccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatacaccagaacaccgtagaaatacgggactctttggacactggtgaacaggtggtgcatggttgtcgtcagctcgtgtcgtgagatgttgggttaagtcccgcaacgagcgcaaccctcgttctatgttgccagcacgttatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcccaacccttgtggagggagccgtcgaa

SEQ ID NO: 761 - DNA, 1357 bp, Ochrobactrum sp.
acatgcaagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgacca

SEQ ID NO: 762 - DNA, 1393 bp, Microbacterium sp.
acatgcaagtcgaacgatgaagcccagcttgctgggtggattagtggcgaacgggtgagtaacacgtgagtaacctgcccctgactctgggataagcgttggaaacgacgtctaatactggatatgactactggtcgcatggcctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggtcgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagccgt

SEQ ID NO: 763 - DNA, 1419 bp, Achromobacter sp.
acatgcaagtcgaacggcagcacagaagagcttgctctttgggtggcgagtggcggacgggtgagtaatgtctgggaaactgcccgatggagggggataactactggaaacggtagctaataccgcataacgtcgcgagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataaccttgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccatatt

SEQ ID NO: 764 - DNA, 1357 bp, Microbacterium sp.
catgcaagtcgagcgccccgcaaggggagcggcagacgggtgagtaacgcgtgggcaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaacgcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgacca

SEQ ID NO: 765 - DNA, 1409 bp, Achromobacter sp.
taccatgcaagtcgaacggcagcacgggtgcttgcacctggtggcgagtggcgaacgggtgagtaatacatcggaacatgtcctgtagtgggggatagcccggcgaaagccggattaataccgcatacgatctacggaagaaagcgggggaccttcgggcctcgcgctatagggttggccgatggctgattagctagttggtggggtaaaggcctaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatcctgagggctaatatccttcggggatgacggtaccggaagaataagcaccggctaactacgtgccagcagccgcggtaatacgtagggtgcgagcgttaatcggaattactgggcgtaaagcgtgcgcaggcggtttgctaagaccgatgtgaaatccccgggctcaacctgggaactgcattggtgactggcaggctagagtatggcagaggggggtagaattccacgtgtagcagtgaaatgcgtagagatgtggaggaataccgatggcgaaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctgaggagactcgggagtgctcgaaagagaaccgatacacaggtgctgcatggctgtcgtcagctcgtgtcgtgagatgttgggttaagtcccgcaacgagcgcaacccttgtccttagttgctacgcaagagcactctaaggagactgccggtgacaaaccggaggaaggtggggatgacgtcaagtcctcatggcccttatgggtagggcttcacacgtcatacaatggtcggaacagagggttgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcacc

SEQ ID NO: 766 - DNA, 1405 bp, Rhodococcus sp.
ccatgcaagtcgaacggcagcacggacttcggtctggtggcgagtggcgaacgggtgagtaatgtatcggaacgtgcctagtagcgggggataactacgcgaaagcgtagctaataccgcatacgccctacgggggaaagcaggggatcgcaagaccttgcactattagagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggctaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagctcaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttagtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaattccgaagagatttggaagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgataccat

SEQ ID NO: 767 - DNA, 1411 bp, Ochrobactrum sp.
catgcaagtcgaacggcagcacggacttcggtctggtggcgagtggcgaacgggtgagtaatgtatcggaacgtgcccagtagcgggggataactacgcgaaagcgtagctaataccgcatacgccctacgggggaaagcaggggatcgtaagaccttgcactattggagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggttaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagcttaactttggaactgcatttttaactaccgggctagagtgtgtcagagggaggtggaattccgcgtgtagcagtgaaatgcgtagatatgcggaggaacaccgatggcgaaaggcagcctcctgggataacactgacgctcatgcacgaaagcgtggggagcaaacaggattagataccctggtagtccacgccctaaacgatgtcaactagctgttggggccttcgggccttggtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaatgccgaagagatttggcagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgataccactagtag

SEQ ID NO: 768 - DNA, 1401 bp, Achromobacter sp.
gcaagtcgaacggcagcacggacttcggtctggtggcgagtggcgaacgggtgagtaatgtatcggaacgtgcctagtagcgggggataactacgcgaaagcgtagctaataccgcatacgccctacgggggaaagcaggggatcgcaagaccttgcactattagagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggctaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagctcaactttggaactgcatttttaactaccgggctagagtgtgtcagagggaggtggaattccgcgtgtagcagtgaaatgcgtagatatgcggaggaacaccgatggcgaaaggcagcctcctgggataacactgacgctcatgcacgaaagcgtggggagcaaacaggattagataccctggtagtccacgccctaaacgatgtcaactagctgttggggccttcgggccttagtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaattccgaagagatttggaagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgatacca

SEQ ID NO: 769 - DNA, 1389 bp, Achromobacter sp.
acggcagcacggacttcggtctggtggcgagtggcgaacgggtgagtaatgtatcggaacgtgcccagtagcgggggataactacgcgaaagcgtagctaataccgcatacgccctacgggggaaagcaggggatcgtaagaccttgcactattggagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggttaataccccgtgaaactgacggtacctgcagaataagcaccggctaactacgtgccagcagccgcggtaatacgtatggtgcaagcgttaatcggaattactgggcgtaaagcgtgcgcaggcggttcggaaagaaagatgtgaaatcccagagcttaactttggaactgcatttttaactaccgggctagagtgtgtcagagggaggtggaattccgcgtgtagcagtgaaatgcgtagatatgcggaggaacaccgatggcgaagcagcctcctgggataacactgacgctcatgcacgaaagcgtggggagcaaacaggattagataccctggtagtccacgccctaaacgatgtcaactagctgttggggccttcgggccttggtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaatgccgaagagatttggcagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgagacc

SEQ ID NO: 770 - DNA, 1401 bp, Rhodococcus sp.
ccatgcagtcgaacggtgaacacggagcttgctctgtgggatcagtggcgaacgggtgagtaacacgtgagcaacctgcccctgactctgggataagcgctggaaacggcgtctaatactggatatgtgacgtgatcgcatggtctgcgtctggaaagaatttcggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggacgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatccggaggctcaacctccggcctgcagtgggtacgggcagactagagtgcggtaggggagattggaattcctggtgtagcggtggaatgcgcagatatcaggaggaacaccgatggcgaaggcagatctctggggccgtaactgacgctgaggagcgaaaggggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcctaacccttgtggagggagccgtcgaat

SEQ ID NO: 771 - DNA, 1390 bp, Microbacterium sp.
aacggcagcacggacttcggtctggtggcgagtggcgaacgggtgagtaatgtatcggaacgtgcctagtagcgggggataactacgcgaaagcgtagctaataccgcatacgccctacgggggaaagcaggggatcgcaagaccttgcactattagagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggctaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagctcaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttagtagcgcagctaacgcgtgaagttgaccgcctggggagtacggtcgcaagattaaaactcaaaggaattgacggggacccgcacaagcggtggatgatgtggattaattcgatgcaacgcgaaaaaaccttacctacccttgacatgtctggaattccgaagagatttggaagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcggat

SEQ ID NO: 772 - DNA, 1364 bp, Ochrobactrum sp.
acacatgcagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccacggtag

SEQ ID NO: 773 - DNA, 1401 bp, Curtobacterium sp.
aagtcgaacggcagcacggacttcggtctggtggcgagtggcgaacgggtgagtaatgtatcggaacgtgcctagtagcgggggataactacgcgaaagcgtagctaataccgcatacgccctacgggggaaagcaggggatcgcaagaccttgcactattagagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggctaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagctcaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttagtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaattccgaagagatttggaagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgataccactg

SEQ ID NO: 774 - DNA, 1393 bp, Erwinia sp.
agtcgaacggcagcacggacttcggtctggtggcgagtggcgaacgggtgagtaatgtatcggaacgtgcctagtagcgggggataactacgcgaaagcgtagctaataccgcatacgccctacgggggaaagcaggggatcgcaagaccttgcactattagagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggctaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagctcaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttagtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaattccgaagagatttggaagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgta

SEQ ID NO: 775 - DNA, 1399 bp, Ochrobactrum sp.
ggcagcacagaggagcttgctccttgggtggcgagtggcggacgggtgaggaatacatcggaatctactctgtcgtgggggataacgtagggaaacttacgctaataccgcatacgacctacgggtgaaagcaggggatcttcggaccttgcgcgattgaatgagccgatgtcggattagctagttggcggggtaaaggcccaccaaggcgacgatccgtagctggtctgagaggatgatcagccacactggaactgagacacggtccagactcctacgggaggcagcagtggggaatattggacaatgggcgcaagcctgatccagccataccgcgtgggtgaagaaggccttcgggttgtaaagcccttttgttgggaaagaaatccagccggctaatacctggttgggatgacggtacccaaagaataagcaccggctaacttcgtgccagcagccgcggtaatacgaagggtgcaagcgttactcggaattactgggcgtaaagcgtgcgtaggtggttatttaagtccgttgtgaaagcccctgggctcaacctgggaactgcagtggatactggatgactagaatgtggtagagggtagcggaattcctggtgtagcagtgaaatgcgtagagatcaggaggaacatccatggcgaaggcagctacctggaccaacattgacactgaggcacgaaagcgtggggagcaaacaggattagataccctggtagtccacgccctaaacgatgcgaactggatgttgggtgcaatttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggccttgacatgtcgagaactttccagagatggattggtgccttcgggaactcgaacacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacggccagggctacacacgtactacaatggtagggacagagggctgcaagccggcgacggtaagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcagttagcttaaccttcgggagggcgc

SEQ ID NO: 776 - DNA, 1413 bp, Burkholderia sp.
cttaccatgcagtcgacggcagcacggacttcggtctggtggcgagtggcgaacgggtgagtaatgtatcggaacgtgcctagtagcgggggataactacgcgaaagcgtagctaataccgcatacgccctacgggggaaagcaggggatcgcaagaccttgcactattagagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggctaataccccgtgaaactgacggtacctgcagaataagcaccggctaactacgtgccagcagccgcggtaatacgtagggtgcaagcgttaatcggaattactgggcgtaaagcgtgcgcaggcggtttcggaaagaaagatgtgaaatcccagagctcaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttagtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaattccgaagagatttggaagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgataccacggtag

SEQ ID NO: 777 - DNA, 1402 bp, Achromobacter sp.
atgcagtcgaacggcagcacggacttcggtctggtggcgagtggcgaacgggtgagtaatgtatcggaacgtgcccagtagcgggggataactacgcgaaagcgtagctaataccgcatacgccctacgggggaaagcaggggatcgtaagaccttgcactattggagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggttaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagcttaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttggtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaatgccgaagagatttggcagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgaatacca

SEQ ID NO: 778 - DNA, 1399 bp, Achromobacter sp.
caagtcgaacggcagcacggacttcggtctggtggcgagtggcgaacgggtgagtaatgtatcggaacgtgcctagtagcgggggataactacgcgaaagcgtagctaataccgcatacgccctacgggggaaagcaggggatcgcaagaccttgcactattagagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggctaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagctcaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttagtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaattccgaagagatttggaagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgatacca

SEQ ID NO: 779 - DNA, 1406 bp, Achromobacter sp.
caagtcgaacggcagcacggacttcggtctggtggcgagtggcgaacgggtgagtaatgtatcggaacgtgcccagtagcgggggataactacgcgaaagcgtagctaataccgcatacgccctacgggggaaagcaggggatcgtaagaccttgcactattggagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggttaataccccgtgaaactgacggtacctgcagaataagcaccgggctaactacgtgccagcagccgcggtaatacgtagggtgcaagcgttaatcggaattactgggcgtaaagcgtgcgcaggcggttcggaaagaaagatgtgaaatcccagagcttaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttggtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaatgccgaagagatttggcagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgataccacgtaga

SEQ ID NO: 780 - DNA, 1389 bp, Achromobacter sp.
tgacagtcgaacggtgaacacggagcttgctctgtgggatcagtggcgaacgggtgagtaacacgtgagcaacctgcccctgactctgggataagcgctggaaacggcgtctaatactggatatgtgacgtgatcgcatggtctgcgtctggaaagaatttcggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggacgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatccggaggctcaacctccggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcctaacccttgtggagggagc

SEQ ID NO: 781 - DNA, 1399 bp, Microbacterium sp.
tacacatgcagtcgaacggtgaacacggagcttgctctgtgggatcagtggcgaacgggtgagtaacacgtgagcaacctgcccctgactctgggataagcgctggaaacggcgtctaatactggatatgtgacgtgatcgcatggtctgcgtctggaaagaatttcggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggacgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatccggaggctcaacctccggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaacccttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcctaacccttgtggagggagccgtc

SEQ ID NO: 782 - DNA, 1364 bp, Achromobacter sp.
gacagtcgacggtgaacacggagcttgctctgtgggatcagtggcgaacgggtgagtaacacgtgagcaacctgcccctgactctgggataagcgctggaaacggcgtctaatactggatatgtgacgtgatcgcatggtctgcgtctggaaagaatttcggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggacgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatccggaggctcaacctccggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggt

SEQ ID NO: 783 - DNA, 1399 bp, Ochrobactrum sp.
atgacagtcgaacggcagcacggacttcggtctggtggcgagtggcgaacgggtgagtaatgtatcggaacgtgcccagtagcgggggataactacgcgaaagcgtagctaataccgcatacgccctacgggggaaagcaggggatcgtaagaccttgcactattggagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggttaataccccgtgaaactgacggtacctgcagaataagcaccggctaactacgtgccagcagccgcggtaatacgtagggtgcaagcgttaatcggaattactgggcgtaaagcgtgcgcaggcgggttcggaaagaaagatgtgaaatcccagagcttaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttggtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaatgccgaagagatttggcagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgat

SEQ ID NO: 784 - DNA, 1398 bp, Achromobacter sp.
acacatgcagtcgaacggtgaacacggagcttgctctgtgggatcagtggcgaacgggtgagtaacacgtgagcaacctgcccctgactctgggataagcgctggaaacggcgtctaatactggatatgtgacgtgatcgcatggtctgcgtctggaaagaatttcggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggacgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatccggaggctcaacctccggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtgggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcctaacccttgtggagggagccgtc

SEQ ID NO: 785 - DNA, 1394 bp, Achromobacter sp.
aacggcagcacggacttcggtctggtggcgagtggcgaacgggtgagtaatgtatcggaacgtgcctagtagcgggggataactacgcgaaagcgtagctaataccgcatacgccctacgggggaaagcaggggatcgcaagaccttgcactattagagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggctaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagctcaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttagtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaattccgaagagatttggaagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgataccacg

SEQ ID NO: 786 - DNA, 1395 bp, Stenotrophomonas sp.
catgcaagtcgaacggtgaacacggagcttgctctgtgggatcagtggcgaacgggtgagtaacacgtgagcaacctgcccctgactctgggataagcgctggaaacggcgtctaatactggatatgtgacgtgatcgcatggtctgcgtctggaaagaatttcggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggacgacggccttcgggttgtaaacctcttttagcagggaagaagcgaaagtgacggtacctgcagaaaaagcgccggctaactacgtgccagcagccgcggtaatacgtagggcgcaagcgttatcctggaattattgggcgtaaagagctcgtaggcggtttgtcgcgtctgctgtgaaatccggaggctcaacctccggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcctaacccttgtggagggagccgt

SEQ ID NO: 787 - DNA, 1382 bp, Achromobacter sp.
gaacggtgaacacggagcttgctctgtgggatcagtggcgaacgggtgagtaacacgtgagcaacctgcccctgactctgggataagcgctggaaacggcgtctaatactggatatgtgacgtgatcgcatggtctgcgtctggaaagaatttcggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggacgacggccttcgggttgtaaacctcttttagcagggaagaagcgaaagtgacggtacctgcagaaaaagcgccggctaactacgtgccagcagccgcggtaatacgtagggcgcaagcgttatccggtaattattgggcgtaaagagctcgtaggcggtttgtcgcgtctgctgtgaaatccggaggctcaacctccggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcctaacccttgtggagggagc

SEQ ID NO: 788 - DNA, 1400 bp, Achromobacter sp.
acacatgcagtcgaacggtgaacacggagcttgctctgtgggatcagtggcgaacgggtgagtaacacgtgagcaacctgcccctgactctgggataagcgctggaaacggcgtctaatactggatatgtgacgtgatcgcatggtctgcgtctggaaagaatttcggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggacgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatccggaggctcaacctccggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaacgttaccaagggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcctaacccttgtggagggagccgtcg

SEQ ID NO: 789 - DNA, 1359 bp, Achromobacter sp.
gaacggtgaacacggagcttgctctgtgggatcagtggcgaacgggtgagtaacacgtgagcaacctgcccctgactctgggataagcgctggaaacggcgtctaatactggatatgtgacgtgatcgcatggtctgcgtctggaaagaatttcggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggacgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatccggaggctcaacctccggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttggacactcgtaaacaggtggtgcatggttgtcgtcagctcgtgtcgtgagatgttgggttaagaaccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtg

SEQ ID NO: 790 - DNA, 1394 bp, Achromobacter sp.
ccatgcagtcgaacgatgaacctggagcttgctctgggggattagtggcgaacgggtgagtaacacgtgagcaacctgcccctgactctgggataagcgctggaaacggcgtctaatactggatacgaacaagaatcgcatggttacttgttggaaagattttttggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcggaagcctgatgcagcaacgccgcgtgagggatgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatcccgaggctcaacctcgggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacggaccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaatgggcagcgataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcctaacccttgtggagggagtcg

SEQ ID NO: 791 - DNA, 1351 bp, Microbacterium sp.
tgacagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctgggggagtacggtcgcaagattaaaactcaaaggaattgacgggggcccgcacaagcggtggagcatgtggtttaattcgaagcaacgcgcagaacccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcagtc

SEQ ID NO: 792 - DNA, 1335 bp, Microbacterium sp.
ttcgggagtcagcggcggacgggtgagtaacgcgtgggaacgtgccttccggttcggaataaccctgggaaactagggctaataccggatacgcccttatggggaaaggtttactgccggaagatcggcccgcgtctgattagctagttggtggggtaacggcctaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctcttttatcccgggacgataatgacggtaccgggaggaataagccccggctaacttcgtgcccagcagccgcggtaatacgaagggggctagcgttgctcggaatcactgggcgtaaagggcgcgtaggcggcgttttaagtcgggggtgaaagcctgtggctcaaccacagaatggccttcgatactgggacgcttgagtatggtagaggttggtggaactgcgagtgtagaggtgaaattcgtagatattcgcaagaacaccggtggcgaaggcggccaactggaccattactgacgctgaggcgcgaaagcgtggggagcaaacaggattagataccctggtagtccacgccgtaaacgatgaatgccagctgttggggtgcttgcaccgcagtagcgcagctaacgctttgagcattccgcctggggagtacggtcgcaagattaaaactcaaaggaattgacgggggcccgcacaagcggtggagcatgtggtttaattcgaagcaacgcgcagaaccttaccatcctttgacatggcgtgttacccagagagatttggggtccacttcggtggcgcgcacacaggtgctgcatggctgtcgtcagctcgtgtcgtgagatgttgggttaagtcccgcaacgagcgcaacccacgtccttagttgccatcattcagttgggcactctagggagactgccggtgataagccgcgaggaaggtgtggatgacgtcaagtcctcatggcccttacgggatgggctacacacgtgctacaatggcggtgacagtgggacgcgaaggagcgatctggagcaaatccccaaaagccgtctcagttcggattgcactctgcaactcgagtgcatgaaggcggaatcgctagtaatcgtggatcagcatgccacggtgaatacgttcccgggccttgtacacaccgcccgtcacaccatgggagttggtcttacccgacggcgctgcgccaaccgcaaggaggcagtc

SEQ ID NO: 793 - DNA, 1387 bp, Microbacterium sp.
cttgctcttcgattcagcggcggacgggtgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccttcgggtcgtaaagcactttaagttgggaggaagggctcatagcgaatacctgtgagttttgacgttaccaacagaataagcaccggctaacttcgtgccagcagccgcggtaatacgaagggtgcaagcgttaatcggaattactgggcgtaaagcgcgcgtaggtggcttgataagttggatgtgaaatccccgggctcaacctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccctcgggaggacggtaccacgag

SEQ ID NO: 794 - DNA, 1411 bp, Achromobacter sp.
gcagtcgagcggatgaagggagcttgctctctgattcagcggcggacgggtgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaacggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccctcgggtcgtaaagcactttaagttgggaggaagggctcatagcgaatacctgtgagttttgacgttaccaacagaataagcaccggctaacttcgtgccagcagccgcggtaatacgaagggtgcaagcgttaatcggaaattactgggcgtaaagcgcgcgtaggtggcttgataagttggatgtgaaatccccgggctcaacctgggaactgcatccaaaactgtctggctagagtgtggtagagggtagtggaatttccagtgtagcggtgaaatgcgtagatattggaaggaacaccagtggcgaaggcgactacctggactaacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccttcgggaggacggtaccacgatg

SEQ ID NO: 795 - DNA, 1412 bp, Microbacterium sp.
ctcatgcagtcgaacggcagcacggacttcggtctggtggcgagtggcgaacgggtgagtaatgtatcggaacgtgcctagtagcgggggataactacgcgaaagcgtagctaataccgcatacgccctacgggggaaagcaggggatcgcaagaccttgcactattagagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggctaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagctcaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttagtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaattccgaagagatttggaagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgataccacggtagat

SEQ ID NO: 796 - DNA, 1396 bp, Achromobacter sp.
cgaacggcagcacggacttcggtctggtggcgagtggcgaacgggtgagtaatgtatcggaacgtgcctagtagcgggggataactacgcgaaagcgtagctaataccgcatacgccctacgggggaaagcaggggatcgcaagaccttgcactattagagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggctaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagctcaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttagtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaattccgaagagatttggaagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgataccact

SEQ ID NO: 797 - DNA, 1391 bp, Microbacterium sp.
aagtcgaacggtgaacacggagcttgctctgtgggatcagtggcgaacgggtgagtaacacgtgagcaacctgcccctgactctgggataagcgctggaaacggcgtctaatactggatatgtgacgtgatcgcatggtctgcgtctggaaagaatttcggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggacgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatccggaggctcaacctccggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcctaacccttgtggagggagccgtcg

SEQ ID NO: 798 - DNA, 1398 bp, Microbacterium sp.
accatgcagtcgaacggtgaacacggagcttgctctgtgggatcagtggcgaacgggtgagtaacacgtgagcaacctgcccctgactctgggataagcgctggaaacggcgtctaatactggatatgtgacgtgatcgcatggtctgcgtctggaaagaatttcggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggacgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatccggaggctcaacctccggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacgggccgcaaggctaaaactcaaaggaattgacggggacccgcacaagcggcggagcatgcggattaattcgatgcaacgcgaagaaccttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcctaacccttgtggagggagccgtcg

SEQ ID NO: 799 - DNA, 1362 bp, Microbacterium sp.
cacatgcagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccacgtac

SEQ ID NO: 800 - DNA, 1352 bp, Microbacterium sp.
tgacagtcgagcgggcccttcggggtcagcggcggacgggtgagtaacgcgtgggaacgtgccttctggttcggaataaccctgggaaactagggctaataccggatacgcccttttggggaaaggtttactgccggaagatcggcccgcgtctgattagctagttggtggggtaacggcctaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctcttttatccgggacgataatgacggtaccggaggaataagccccggctaacttcgtgccagcagccgcggtaatacgaagggggctagcgttgctcggaatcactgggcgtaaagggcgcgtaggcggcgttttaagtcgggggtgaaagcctgtggctcaaccacagaatggcctttcgatactgggacgcttgagtatggtagaggttggtggaactgcgagtgtagaggtgaaattcgtagatattcgcaagaacaccggtggcgaaggcggccaactggaccattactgacgctgaggcgcgaaagcgtggggagcaaacaggattagataccctggtagtccacgccgtaaacgatgaatgccagctgttggggtgcttgcaccgcagtagcgcagctaacgctttgagcattccgcctggggagtacggtcgcaagattaaaactcaaaggaattgacgggggcccgcacaagcggtggagcatgtggtttaattcgaagcaacgcgcagaaccttaccatcctttgacatggcgtgttacccagagagatctggggtccccttcgggggcgcgcacacaggtgctgcatggctgtcgtcagctcgtgtcgtgagatgttgggttaagtcccgcaacgagcgcaacccacgtccttagttgccatcattcagttgggcactctagggagactgccggtgataagccgcgaggaaggtgtggatgacgtcaagtcctcatggcccttacgggatgggctacacacgtgctacaatggcggtgacagtgggaggcgaaggagcgatctggagcaaatccccaaaagccgtctcagttcggattgcactctgcaactcgagtgcatgaaggcggaatcgctagtaatcgtggatcagcatgccacggtgaatacgttcccgggccttgtacacaccgcccgtcacaccatgggagttggtcttacccgacggcgctgggccaaccgcaaggaggcaggcgt

SEQ ID NO: 801 - DNA, 1357 bp, Microbacterium sp.
cacatgcagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgacca

SEQ ID NO: 802 - DNA, 1398 bp, Ochrobactrum sp.
atgacagtcgaacggcagcacggacttcggtctggtggcgagtggcgaacgggtgagtaatgtatcggaacgtgcctagtagcgggggataactacgcgaaagcgtagctaataccgcatacgccctacgggggaaagcaggggatcgcaagaccttgcactattagagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggctaataccccgtgaaactgacggtacctgcagaataagcaccggctaactacgtgccagcagccgcggtaatacgtagggtgcaagcgttaatcggaattactgggcgtaaagcgtgcgcaggcggtttcggaaagaaagatgtgaaatcccagagctcaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttagtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaattccgaagagatttggaagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcga

SEQ ID NO: 803 - DNA, 1386 bp, Methylobacterium sp.
aagtcgaacggtgaagccaagcttgcttggtggatcagtggcgaacgggtgagtaacacgtgagcaacctgccctggactctgggataagcgctggaaacggcgtctaatactggatatgagacgtgatcgcatggtcgtgtttggaaagatttttcggtctgggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcggaagcctgatgcagcaacgccgcgtgagggatgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatcccgaggctcaacctcgggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggaccattccacggtttccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcccaacccttgtggagggagccg

SEQ ID NO: 804 - DNA, 1361 bp, Pseudomonas sp.
agcttgcttctttgctgacgagtggcggacgggtgagtaatgtctgggaaactgcctgatggagggggataactactggaaacggtagctaataccgcataacgtcgcaagaccaaagagggggaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttgctcattgacgttacccgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatctgatactggcaagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaagttttcagagatgagaatgtgccttcgggaaccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtagtaa

SEQ ID NO: 805 - DNA, 1358 bp, Pseudomonas sp.
ttgcttctttgctgacgagtggcggacgggtgagtaatgtctgggaaactgcctgatggagggggataactactggaaacggtagctaataccgcataacgtcgcaagaccaaagagggggaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttgctcattgacgttacccgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatctgatactggcaagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaagttttcagagatgagaatgtgccttcgggaaccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtagtaa

SEQ ID NO: 806 - DNA, 1354 bp, Achromobacter sp.
aacgaaggcttcggccttagtggcgcacgggtgcgtaacgcgtgggaatctgccctttggttcggaataacagctggaaacggctgctaataccggatgatgacgaaagtccaaagatttatcgccagaggatgagcccgcgttggattaggtagttggtggggtaaaggcctaccaagccgacgatccatagctggtctgagaggatgatcagccacactgggactgagacacggcccagactcctacgggaggcagcagtggggaatattggacaatgggcgaaagcctgatccagcaatgccgcgtgagtgatgaaggccctagggttgtaaagctcttttacccgggaagataatgactgtaccgggagaataagccccggctaactccgtgccagcagccgcggtaatacggagggggctagcgttgttcggaattactgggcgtaaagcgcacgtaggcggctttgtaagtcagaggtgaaagcctggagctcaactccagaactgcctttgagactgcatcgcttgaatccaggagaggtcagtggaattccgagtgtagaggtgaaattcgtagatattcggaagaacaccagtggcgaaggcggctgactggactggtattgacgctgaggtgcgaaagcgtggggagcaaacaggattagataccctggtagtccacgccgtaaacgatgataactagctgtccgggcacttggtgcttggggtggcgcagctaacgcattaagttatccgcctggggagtacggccgcaaggttaaaactcaaaggaattgacgggggcctgcacaagcggtggagcatgtggtttaattcgaagcaacgcgcagaaccttaccagcgtttgacatgtccggacgactggcagagatgcctttcttcccttcggggactggaacacaggtgctgcatggctgtcgtcagctcgtgtcgtgagatgttgggttaagtcccgcaacgagcgcaaccctcgcctttagttaccatcatttggttgggtactctaaaggaaccgccggtgataagccggaggaaggtggggatgacgtcaagtcctcatggcccttacgcgctgggctacacacgtgctacaatggcaactacagtgggcagcgaccctgcgagggcgagctaatccccaaaagttgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgttgcgccaacccgcaaggaagcaggcgaccacgtgt

SEQ ID NO: 807 - DNA, 1383 bp, Achromobacter sp.
tgacagtcgagcggtaaggcctttcggggtacacgagcggcgaacgggtgagtaacacgtgggtgatctgccctgcacttcgggataagcctgggaaactgggtctaataccggatatgacctcctatcgcatggtgggtggtggaaagatttatcggtgcaggatgggcccgcggcctatcagcttgttggtggggtaatggcctaccaaggcgacgacgggtagccgacctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggacgaagcgcaagtgacggtacctgcagaagaagcaccggctaactacgtgccagcagccgcggtaatacgtagggtgcaagcgttgtccggaattactgggcgtaaagagttcgtaggcggtttgtcgcgtcgtttgtgaaaaccagcagctcaactgctggcttgcaggcgatacgggcagacttgagtactgcaggggagactggaattcctggtgtagcggtgaaatgcgcagatatcaggaggaacaccggtggcgaaggcgggtctctgggcagtaactgacgctgaggaacgaaagcgtgggtagcgaacaggattagataccctggtagtccacgccgtaaacggtgggcgctaggtgtgggttccttccacggaatccgtgccgtagctaacgcattaagcgccccgcctggggagtacggccgcaaggctataactcaaaggaattgacgggggcccgcacaagcggcggagcatgtggattaattcgatgcaacgcgaagaaccttacctgggtttgacatataccggaaagctgcagagatgtggccccccttgtggtcggtatacaggtggtgcatggctgtcgtcagctcgtgtcgtgagatgttgggttaagtcccgcaacgagcgcaacccctatcttatgttgccagcacgttatggtggggactcgtaagagactgccggggtcaactcggaggaaggtggggacgacgtcaagtcatcatgccccttatgtccagggcttcacacatgctacaatggccagtacagagggctgcgagaccgtgaggtggagcgaatcccttaaagctggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggtcttaaccccttgtgggagggag

SEQ ID NO: 808 - DNA, 1364 bp, Microbacterium sp.
acggtgaacacggagcttgctctgtgggatcagtggcgaacgggtgagtaacacgtgagcaacctgcccctgactctgggataagcgctggaaacggcgtctaatactggatatgtgacgtgatcgcatggtctgcgtctggaaagaatttcggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggacgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatccggaggctcaacctccggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggcgtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcctaac

SEQ ID NO: 809 - DNA, 1381 bp, Microbacterium sp.
gagcttgctcctcgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaacggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcagtgaggttaataaccttactgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtatacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtagttagcttaacctccgggagggc

SEQ ID NO: 810 - DNA, 1397 bp, Ochrobactrum sp.
agtcgagcggatgagaggagcttgctcttcgattcagcggcggacgggtgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccttcgggtcgtaaagcactttaagttgggaggaagggctcatagcgaatacctgtgagttttgacgttaccaacagaataagcaccggctaacttcgtgccagcagccgcggtaatacgaagggtgcaagcgttaatcggaattactgggcgtaaagcgcgcgtaggtggcttgataagttggatgtgaaatccccgggctcaacctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccctcgggaggaca

SEQ ID NO: 811 - DNA, 1363 bp, Methylobacterium sp.
gatgatcaggagcttgctcctgtgattagtggcgaacgggtgagtaacacgtgagtaacctgcccctgactctgggataagcgttggaaacgacgtctaatactggatatgatcactggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggtcgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaaccct

SEQ ID NO: 812 - DNA, 1365 bp, Ochrobactrum sp.
gcgatgatcaggagcttgctcctgtgattagtggcgaacgggtgagtaacacgtgagtaacctgcccctgactctgggataagcgttggaaacgacgtctaatactggatatgatcactggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtaggggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggtcgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaaccc

SEQ ID NO: 813 - DNA, 1349 bp, Achromobacter sp.
acagtcgagcgggcccttcgggagtcagcggcggacgggtgagtaacgcgtgggaacgtgccttctggttcggaataaccctgggaaactagggctaataccggatacgcccttttggggaaaggtttactgccggaagatcggcccgcgtctgattagctagttggtggggtaacggcctaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctcttttatccgggacgataatgacggtaccggaggaataagccccggctaacttcgtgccagcagccgcggtaatacgaagggggctagcgttgctcggaatcactgggcgtaaagggcgcgtaggcggcgttttaagtcgggggtgaaagcctgtggctcaaccacagaatggccttcgatactgggacgcttgagtatggtagaggttggtggaactgcgagtgtagaggtgaaattcgtagatattcgcaagaacaccggtggcgaaggcggccaactggaccattactgacgctgaggcgcgaaagcgtggggagcaaacaggattagataccctggtagtgcacgccgtaaacgatgaatgccagctgttggggtgcttgcaccgcagtagcgcagctaacgctttgagcattccgcctggggagtacggtcgcaagattaaaactcaaaggaattgacgggggcccgcacaagcggtggagcatgtggtttaattcgaagcaacgcgcagaaccttaccatcctttgacatggcgtgttacccagagagatctggggtccccttcgggggcgcgcacacaggtgctgcatggctgtcgtcagctcgtgtcgtgagatgttgggttaagtcccgcaacgagcgcaacccacgtccttagttgccatcattcagttgggcactctagggagactgccggtgataagccgcgaggaaggtgtggatgacgtcaagtcctcatggcccttacgggatgggctacacacgtgctacaatggcggtgacagtgggaggcgaaggagcgatctggagcaaatccccaaaagccgtctcagttcggattgcactctgcaactcgagtgcatgaaggcggaatcgctagtaatcgtggatcagcatgccacggtgaatacgttcccgggccttgtacacaccgcccgtcacaccatgggagttggtcttacccgacggcgctgcgccaaccgcaaggaggcaggta

SEQ ID NO: 814 - DNA, 1363 bp, Microbacterium sp.
tgacagtcgagcggtaaggcctttacggggtacacgagcggcgaacgggtgagtaacacgtgggtgatctgccctgcacttcgggataagcctgggaaactgggtctaataccggatatgacctcctatcgcatggtgggtggtggaaagatttatcggtgcaggatgggcccgcggcctatcagcttgttggtggggtaatggcctaccaaggcgacgacgggtagccgacctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggacgaagcgcaagtgacggtacctgcagaagaagcaccggctaactacgtgccagcagccgcggtaatacgtagggtgcaagcgttgtccggaattactgggcgtaaagagttcgtaggcggtttgtcgcgtcgtttgtgaaaaccagcagctcaactgctggcttgcaggcgatacgggcagacttgagtactgcaggggagactggaattcctggtgtagcggtgaaatgcgcagatatcaggaggaacaccggtggcgaaggcgggtctctgggcagtaactgacgctgaggaacgaaagcgtgggtagcgaacaggattagataccctggtagtccacgccgtaaacggtgggcgctaggtgtgggttccttccacggaatccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggtttgacatataccggaaagctgcagagatgtggccccccttgtggtcggtatacaggtggtgcatggctgtcgtcagctcgtgtcgtgagatgttgggttaagtcccgcaacgagcgcaacccctatcttatgttgccagcacgttatggtggggactcgtaagagactgccggggtcaactcggaggaaggtggggacgacgtcaagtcatcatgccccttatgtccagggcttcacacatgctacaatggccagtacagagggctgcgagaccgtgaggtggagcgaatcccttaaagctggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggtc

SEQ ID NO: 815 - DNA, 1265 bp, Enterobacteriaceae
gattgctgggtggattagtggcgaacgggtgagtaacacgtgagtaacctgcccctgactctgggataagcgttggaaacgacgtctaatactggatacgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggtcgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaac

SEQ ID NO: 816 - DNA, 1351 bp, Enterobacteriaceae
agacagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacggcggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgt

SEQ ID NO: 817 - DNA, 1412 bp, Sphingomonas sp.
catgcagtcgagcggatgagaggagcttgctcctctgattcagcggcggacgggtgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccttcgggtcgtaaagcactttaagttgggaggaagggctcatagcgaatacctgtgagttttgacgttaccaacagaataagcaccggctaacttcgtgccagcagccgcggtaatacgaagggtgcaagcgttaatcggaattactgggcgtaaagcgcgcgtaggtggcttgataagttggatgtgaaatccccgggctcaacctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccctcgggaggacggtaccacgg

SEQ ID NO: 818 - DNA, 1400 bp, Rhodococcus sp.
cgaacggcagcacggacttcggtctggtggcgagtggcgaacgggtgagtaatgtatcggaacgtgcctagtagcgggggataactacgcgaaagcgtagctaataccgcatacgccctacgggggaaagcaggggatcgcaagaccttgcactattagagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggctaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagctcaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttagtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaattccgaagagatttggaagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgataccacgtaga

SEQ ID NO: 819 - DNA, 1399 bp, Microbacterium sp.
gcagtcgaacggcagcacggacttcggtctggtggcgagtggcgaacgggtgagtaatgtatcggaacgtgcctagtagcgggggataactacgcgaaagcgtagctaataccgcatacgccctacgggggaaagcaggggatcgcaagaccttgcactattagagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggctaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagctcaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttagtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaattccgaagagatttggaagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgatacca

SEQ ID NO: 820 - DNA, 1414 bp, Enterobacteriaceae
tgcagtcgaacggcagcacagcagagcttgctctgtgggtggcgagtggcggacgggtgagtaatgcatcgggacctacccagacgtgggggataacgtagggaaacttacgctaataccgcatacgtcctacgggagaaagcgggggatcgcaagacctcgcgcggttggatggaccgatgtgcgattagctagttggtgaggtaatggctcaccaaggcgacgatcgctagctggtctgagaggatgatcagccacactgggactgagacacggcccagactcctacgggaggcagcagtggggaatattggacaatgggcgcaagcctgatccagcaatgccgcgtgtgtgaagaaggccctcgggttgtaaagcacttttatcaggagcgaaatctgcaaggttaatacctttgcagtctgacggtacctgaggaataagcaccggctaactccgtgccagcagccgcggtaatacggagggtgcaagcgttaatcggaattactgggcgtaaagcgtgcgtaggcggttcgttaagtctgctgtgaaagccccgggctcaacctgggaatggcagtggatactggcgagctagagtgtgatagaggatggtggaattcccggtgtagcggtgaaatgcgtagagatcgggaggaacatcagtggcgaaggcggccatctggatcaacactgacgctgaggcacgaaagcgtggggagcaaacaggattagataccctggtagtccacgccctaaacgatgcgaactggatgttggtctcaactcggagatcagtgtcgaagctaacgcgttaagttcgccgcctggggagtacggtcgcaagactgaaactcaaaggaattgacgggggcccgcacaagcggtggagtatgtggtttaattcgatgcaacgcgaagaaccttacctgggcttgacatgtccggaatcctgcagagatgcgggagtgccttcgggaatcggaacacaggtgctgcatggctgtcgtcagctcgtgtcgtgagatgttgggttaagtcccgcaacgagcgcaacccttgtccttagttgccagcgagtaatgtcgggaactctaaggagactgccggtgacaaaccggaggaaggtggggatgacgtcaagtcatcatggcccttacggccagggctacacacgtactacaatggtcggtacagagggttgcgataccgcgaggtggagctaatcccagaaagccgatcccagtccggattggagtctgcaactcgactccatgaagtcggaatcgctagtaatcgcagatcagctatgctgcggtgaatacgttcccgggccttgtacacaccgcccgtcacaccatgggagtgagctgctccagaagccgttagtctaaccgcaagggggacgacgacc

SEQ ID NO: 821 - DNA, 1366 bp, Pseudomonas sp.
acggtgaagccaagcttgcttggtggatcagtggcgaacgggtgagtaacacgtgagcaacctgccctggactctgggataagcgctggaaacggcgtctaatactggatatgagcctcttccgcatggtgggggttggaaagattttttggtctgggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcggaagcctgatgcagcaacgccgcgtgagggatgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatcccgaggctcaacctcgggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggaccattccacggtttccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatacaccagaacgggccagaaatggtcaactctttggacactggtgaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcccaaccctt

SEQ ID NO: 822 - DNA, 1355 bp, Curtobacterium sp.
ttctttgctgacgagtggcggacgggtgagtaatgtctgggaaactgcctgatggagggggataactactggaaacggtagctaataccgcataacgtcgcaagaccaaagagggggaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttgctcattgacgttacccgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatctgatactggcaagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaagttttcagagatgagaatgtgccttcgggaaccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtagtaga

SEQ ID NO: 823 - DNA, 1373 bp, Curtobacterium sp.
cagtcgaacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaaccctt

SEQ ID NO: 824 - DNA, 1402 bp, Methylobacterium sp.
acggcagcacagcagagcttgctctgtgggtggcgagtggcggacgggtgagtaatgcatcgggacctacccagacgtgggggataacgtagggaaacttacgctaataccgcatacgtcctacgggagaaagcgggggatcgcaagacctcgcgcggttggatggaccgatgtgcgattagctagttggtgaggtaatggctcaccaaggcgacgatcgctagctggtctgagaggatgatcagccacactgggactgagacacggcccagactcctacgggaggcagcagtggggaatattggacaatgggcgcaagcctgatccagcaatgccgcgtgtgtgaagaaggccctcgggttgtaaagcacttttatcaggagcgaaatctgcaaggttaatacctttgcagtctgacggtacctgaggaataagcaccggctaactccgtgccagcagccgcggtaatacggagggtgcaagcgttaatcggaattactgggcgtaaagcgtgcgtaggcggttcgttaagtctgctgtgaaagccccgggctcaacctgggaatggcagtggatactggcgagctagagtgtgatagaggatggtggaattcccggtgtagcggtgaaatgcgtagagatcgggaggaacatcagtggcgaaggcggccatctggatcaacactgacgctgaggcacgaaagcgtggggagcaaacaggattagataccctggtagtccacgccctaaacgatgcgaactggatgttggtctcaactcggagatcagtgtcgaagctaacgcgttaagttcgccgcctggggagtacggtcgcaagactgaaactcaaaggaattgacggcggcccgcacaagcggtggagtatgtggtttaattcgatgcaacgcgaagaaccttacctggccttgacatgtccggaatcctgcagagatgcgggagtgccttcgggaatcggaacacaggtgctgcatggctgtcgtcagctcgtgtcgtgagatgttgggttaagtcccgcaacgagcgcaacccttgtccttagttgccagcgagtaatgtcgggaactctaaggagactgccggtgacaaaccggaggaaggtggggatgacgtcaagtcatcatggcccttacggccagggctacacacgtactacaatggtcggtacagagggttgcgataccgcgaggtggagctaatcccagaaagccgatcccagtccggattggagtctgcaactcgactccatgaagtcggaatcgctagtaatcgcagatcagctatgctgcggtgaatacgttcccgggccttgtacacaccgcccgtcacaccatgggagtgagctgctccagaagccgttagtctaaccgcaagggggacgtcg

SEQ ID NO: 825 - DNA, 1363 bp, Rhodococcus sp.
agagcttgctcctcgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaacggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgaggttaataaccttgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacgggcgcaaggttaaaactcaatgcatttgacgggggcccgcacaagcggtggagcatgtggtttaattcgatgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtagtag

SEQ ID NO: 826 - DNA, 1304 bp, Curtobacterium sp.
catgcaagtcgagcgggcatccttgtggtgtcagcggcagacgggtgagtaacgcgtgggaacgtgcccttcggttcggaataactcagggaaacttgagctaataccggatacgtgcgagagcagaaaggtttactgccgaaggatcggcccgcgtctgattagctagttggtgaggttacggctcaccaaggcgacgatcagtagctggtctgagaggatgatcagccacactgggactgagacacggcccagactcctacgggaggcagcagtggggaatattggacaatgggggcaaccctgatccagccatgccgcgtgagtgatgacggccttagggttgtaaagctcttttctccgggacgataatgacggtaccggaggaataagccccggctaacttcgtgccagcagccgcggtaatacgaagggggctagcgttgctcggaatcactgggcgtaaagggcgcgtaggcggctgatttagtcgagggtgaaagcccgtggctcaaccacggaatggccttcgatactgattggctcgagaccggaagaggacagcggaactgcgagtgtagaggtgaaattcgtagatattcgcaagaacaccagtggcgaaggcggctgtctggtccggttctgacgctgaggcgcgaaagcgtggggagcaaacaggattagataccctggtagtccacgctgtaaacgatgaatgctagccgttggggtgcatgcacctcagtggcgccgctaacgctttaagcattccgcctggggagtacggtcgcaagattaaaactcaaaggaattgacgggggcccgcacaagcggtggagcatgtggtttaatttgaagcaacgcgcagaaccttaccatcccttgacatggcatgcgagctggagagatcggctgttcccttcggggacgtgcacacaggtgctgcatggctgtcgtcagctcgtgtcgtgagatgttgggttaagtcccgcaacgagcgcaacccacgtcttcagttgccatcatttggttgggcactctggggagactgccggtgataagccgcgaggaaggtgtggatgacgtcaagtcttcatggcccttacgggatgggctacacacgtgctacaatggcggtgacaatgggcagcgaaggggcgacctggagagaatccccaaaagccgtctcagttcggattgcactctgcaactcgggtgcacgaaggcggaatcgctagtaatcgtggatcagcatgccacggtgaatacgttcccgggccttgtacacaccgcccgtcacacca

SEQ ID NO: 827 - DNA, 1213 bp, Ochrobactrum sp.
gctaataccggatacgcccttatggggaaaggtttactgccggaagatcggcccgcgtctgattagctagttggtggggtaacggcctaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctcttttatccgggacgataatgacggtaccggaggaataagccccggctaacttcgtgccagcagccgcggtaatacgaagggggctagcgttgctcggaatcactgggcgtaaagggcgcgtaggcggcgttttaagtcgggggtgaaagcctgtggctcagccacagaatggccttcgatactgggacgcttgagtatggtagaggttggtggaactgcgagtgtagaggtgaaattcgtagatattcgcaagaacaccggtggcgaaggcggccaactggaccattactgacgctgaggcgcgaaagcgtggggagcaaacaggattagataccctggtagtccacgccgtaaacgatgaatgccagctgttggggtgcttgcaccgcactagcgcagctaacgctttgagcattccgcctggggagtacggtcgcaagattaaaactcaaaggaattgacgggggcccgcacaagcggtggagcatgtggtttaattcgaagcaacgcgcagaaccttaccatcctttgacatggcgtgttacccagagagatttggggtccacttcggtggcgcgcacacaggtgctgcatggctgtcgtcagctcgtgtcgtgagatgttgggttaagtcccgcaacgagcgcaacccacgtccttagttgccatcattcagttgggcactctagggagactgccggtgataagccgcgaggaaggtgtggatgacgtcaagtcttcatggcccttacgggatgggctacacacgtgctacaatggcggtgacagtgggacgcgaaggagcgatctggagcaaatccccaaaagccgtctcagttcggattgcactctgcaactcgagtgcatgaaggcggaatcgctagtaatcgtggatcagcatgccacggtgaatacgttcccgggccttgtacacaccgcccgtcacaccatgggagtt

SEQ ID NO: 828 - DNA, 1413 bp, Pseudomonas sp.
ccatgcagtcgagcggatgagaggagcttgctcctcgattcagcggcggacgggtgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccttcgggtcgtaaagcactttaagttgggaggaagggctcatagcgaatacctgtgagttttgacgttaccaacagaataagcaccggctaacttcgtgccagcagccgcggtaatacgaagggtgcaagcgttaatcggaattactgggcgtaaagcgcgcgtaggtggcttgataagttggatgtgaaatccccgggctcaacctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccctcgggaggacggtaccacgga

SEQ ID NO: 829 - DNA, 1408 bp, Achromobacter sp.
caagtcgagcggatgagaggagcttgctcctcgattcagcggcggacgggtgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccttcgggtcgtaaagcactttaagttgggaggaagggctcatagcgaatacctgtgagttttgacgttaccaacagaataagcaccggctaacttcgtgccagcagccgcggtaatacgaagggtgcaagcgttaatcggaattactgggcgtaaagcgcgcgtaggtggcttgataagttggatgtgaaatccccgggctcaacctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccctcgggaggacggtaccacga

SEQ ID NO: 830 - DNA, 1361 bp, Achromobacter sp.
gcttgcttctttgctgacgagtggcggacgggtgagtaatgtctgggaaactgcctgatggagggggataactactggaaacggtagctaataccgcataacgtcgcaagaccaaagagggggaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttgctcattgacgttacccgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatctgatactggcaagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtatacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaagttttcagagatgagaatgtgccttcgggaaccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtagtaga

SEQ ID NO: 831 - DNA, 1405 bp, Luteibacter sp.
gacagtcgagcggatgagaggagcttgctcttcgattcagcggcggacgggtgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccttcgggtcgtaaagcactttaagttgggaggaagggctcatagcgaatacctgtgagttttgacgttaccaacagaataagcaccggctaacttcgtgccagcagccgcggtaatacgaagggtgcaagcgttaatcggaattactgggcgtaaagcgcgcgtaggtggcttgataagttggatgtgaaatccccgggctcaacctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtgggggagcaaacaggattagataccctggtagtccacgccgtaaacgatgtcaactagccgttgggatccttgagatcttagtggcgcagctaacgcattaagttgaccgcctgggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccctcgggaggacggta

SEQ ID NO: 832 - DNA, 1400 bp, Microbacterium sp.
agacagtcgaacggcagcataggagcttgctcctgatggcgagtggcgaacgggtgagtaatatatcggaacgtgccctagagtgggggataactagtcgaaagactagctaataccgcatacgatctacggatgaaagtgggggatcgcaagacctcatgctcctggagcggccgatatctgattagctagttggtggggtaaaagcctaccaaggcaacgatcagtagctggtctgagaggacgaccagccacactgggactgagacacggcccagactcctacgggaggcagcagtggggaattttggacaatgggggcaaccctgatccagcaatgccgcgtgagtgaagaaggccttcgggttgtaaagctcttttgtcagggaagaaacggtagtagctaatatctattactaatgacggtacctgaagaataagcaccggctaactacgtgccagcagccgcggtaatacgtagggtgcaagcgttaatcggaattactgggcgtaaagcgtgcgcaggcggttgtgtaagtcagatgtgaaatccccgggctcaaccctgggaattgcatttgagactgcacggctagagtgtgtcagaggggggtagaattccacgtgtagcagtgaaatgcgtagatatgtggaggaataccgatggcgaaggcagccccctgggataacactgacgctcatgcacgaaagcgtggggagcaaacaggattagataccctggtagtccacgccctaaacgatgtctactagttgtcgggtcttaattgacttggtaacgcagctaacgcgtgaagtagaccgcctggggagtacggtcgcaagattaaaactcaaaggaattgacggggacccgcacaagcggtggatgatgtggattaattcgatgcaacgcgaaaaaccttacctacccttgacatggatggaatcccgaagagatttgggagtgctcgaaagagaaccatcacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtacatacagagggccgccaacccgcgagggggagctaatcccagaaagtgtatcgtagtccggattggagtctgcaactcgactccatgaagttggaatcgctagtaatcgcggatcagcatgtcgcggtgaatacgttcccgggtcttgtacacaccgcccgtcacaccatgggagcgggttttaccagaagtgggtagcctaaccgcaaggagggcgta

SEQ ID NO: 833 - DNA, 1344 bp, Enterobacteriaceae
agattgctgggtggattagtggcgaacgggtgagtaacacgtgagtaacctgcccctgactctgggataagcgttggaaacgacgtctaatactggatatgactactggtcgcatggcctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtatacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggtcgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtgg

SEQ ID NO: 834 - DNA, 1412 bp, Curtobacterium sp.
tgacagtcgaacggcagcacaggagagcttgctctctgggtggcgagtggcggacgggtgaggaatacatcggaatctaccttttcgtgggggataacgtagggaaacttacgctaataccgcatacgaccttagggtgaaagcggaggaccttcgggcttcgcgcggatagatgagccgatgtcggattagctagttggcggggtaaaggcccaccaaggcgacgatccgtagctggtctgagaggatgatcagccacactggaactgagacacggtccagactcctacgggaggcagcagtggggaatattggacaatgggcgcaagcctgatccagccatgccgcgtgggtgaagaaggccttcgggttgtaaagcccttttgttgggaaagaaaagcagtcggttaatacccgattgttctgacggtacccaaagaataagcaccggctaacttcgtgccagcagccgcggtaatacgaagggtgcaagcgttactcggaattactgggcgtaaagcgtgcgtaggtggttgtttaagtccgttgtgaaagccctgggctcaacctgggaattgcagtggatactgggcaactagagtgtggtagaggatggcggaattcccggtgtagcagtgaaatgcgtagagatcgggaggaacatctgtggcgaaggcggccatctggaccaacactgacactgaggcacgaaagcgtggggagcaaacaggattagataccctggtagtccacgccctaaacgatgcgaactggatgttgggtgcaacttgggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggtcttgacatccacggaactttccagagatggattggtgccttcgggaaccgtgagacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacgaccagggctacacacgtactacaatggtagggacagagggctgcaagccggcgacggtaagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgta

SEQ ID NO: 835 - DNA, 1364 bp, Luteibacter sp.
agagcttgctcctcgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaacggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcaatgaggttaataaccttgctgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtagtaag

SEQ ID NO: 836 - DNA, 1380 bp, Enterobacteriaceae
tgacagtcgaacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctgggggagtacggccgcaaggctaaaactcaaaggaattgacgggggcccgcacaagcggcggagcatgcggattaattcgatgcaacgcgaagaaccttaccaaggcttgacatacaccggaaacggccagagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtg

SEQ ID NO: 837 - DNA, 1418 bp, Methylobacteriaceae
cacatgcagtcggacggtagcacagagagagcttgctcctcgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaacggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcaatgaggttaataaccttgctgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtatacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtagttagcttaaccttcgggagggcgctaccact

SEQ ID NO: 838 - DNA, 1343 bp, Methylobacterium sp.
tcgcaagatgagtggcagacgggtgagtaacgcgtgggaacatacccttttctacggaatagctctgggaaactggaattaataccgtatacgccctacgggggaaagatttatcggggaaggattggcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctctttcaccgatgaagataatgacggtagtcggagaagaagccccggctaacttcgtgccagcagccgcggtaatacgaagggggctagcgttgttcggaattactgggcgtaaagcgcacgtaggcggatatttaagtcaggggtgaaatcccagagctcaactctggaactgcctttgatactgggtatcttgagtatggaagaggtaagtggaattgcgagtgtagaggtgaaattcgtagatattcgcaggaacaccagtggcgaaggcggcttactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagctcttgacattcggggtatggtcattggagacgatgaccttcagttcggctggccctagaacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagacagcgatgtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttttacccgaaggcgctgcgctaaccgcaagggggcaggcgaccaca

SEQ ID NO: 839 - DNA, 1386 bp, Pseudomonas sp.
tgacagtcgaacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggag

SEQ ID NO: 840 - DNA, 1363 bp, Pseudomonas sp.
agagcttgctcctcgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaacggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcaatgaggttaataaccttgctgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtagtat

SEQ ID NO: 841 - DNA, 1352 bp, Enterobacteriaceae
tgacagtcgagcggacctttcgggagtcagcggcggacgggtgagtaacgcgtgggaacgtgccttccggttcggaataaccctgggaaactagggctaataccggatacgcccttttggggaaaggtttactgccggaagatcggcccgcgtctgattagctagttggtggggtaacggcctaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctcttttatccgggacgataatgacggtaccggaggaataagccccggctaacttcgtgccagcagccgcggtaatacgaagggggctagcgttgctcggaatcactgggcgtaaagggcgcgtaggcggcgttttaagtcgggggtgaaagcctgtggctcaaccacagaatggcctttcgatactgggacgcttgagtatggtagaggttggtggaactgcgagtgtagaggtgaaattcgtagatattcgcaagaacaccggtggcgaaggcggccaactggaccattactgacgctgaggcgcgaaagcgtggggagcaaacaggattagataccctggtagtccacgccgtaaacgatgaatgccagctgttggggtgcttgcaccgcagtagcgcagctaacgctttgagcattccgcctggggagtacggtcgcaagattaaaactcaaaggaattgacgggggcccgcacaagcggtggagcatgtggtttaattcgaagcaacgcgcagaaccttaccatcctttgacatggcgtgttacccagagagatttggggtccacttcggtggcgcgcacacaggtgctgcatggctgtcgtcagctcgtgtcgtgagatgttgggttaagtcccgcaacgagcgcaacccacgtccttagttgccatcattcagttgggcactctagggagactgccggtgataagccgcgaggaaggtgtggatgacgtcaagtcctcatggcccttacgggatgggctacacacgtgctacaatggcggtgacagtgggacgcgaaggagcgatctggagcaaatccccaaaagccgtctcagttcggattgcactctgcaactcgagtgcatgaaggcggaatcgctagtaatcgtggatcagcatgccacggtgaatacgttcccgggccttgtacacaccgcccgtcacaccatgggagttggtcttacccgacggcgctgcgccaaccgcaaggaggcaggtg

SEQ ID NO: 842 - DNA, 1335 bp, Pseudomonas sp.
gatgggtgagtaatgtctgggaaactgcctgatggagggggataactactggaaacggtagctaataccgcataacgtcgcaagaccaaagagggggaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttgctcattgacgttacccgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatctgatactggcaagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaagttttcagagatgagaatgtgccttcgggaaccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtagtagg

SEQ ID NO: 843 - DNA, 1422 bp, Herbaspirillum sp.
acacatgcagtcgaacggcagcacaggagagcttgctctctgggtggcgagtggcggacgggtgaggaatacatcggaatctaccttttcgtgggggataacgtagggaaacttacgctaataccgcatacgaccttagggtgaaagcggaggaccttcgggcttcgcgcggatagatgagccgatgtcggattagctagttggcggggtaaaggcccaccaaggcgacgatccgtagctggtctgagaggatgatcagccacactggaactgagacacggtccagactcctacgggaggcagcagtggggaatattggacaatgggcgcaagcctgatccagccatgccgcgtgggtgaagaaggccttcgggttgtaaagcccttttgttgggaaagaaaagcagtcggttaatacccgattgttctgacggtacccaaagaataagcaccggctaacttcgtgccagcagccgcggtaatacgaagggtgcaagcgttactcggaattactgggcgtaaagcgtgcgtaggtggttgtttaagtccgttgtgaaagccctgggctcaacctgggaattgcagtggatactgggcaactagagtgtggtagaggatggcggaattcccggtgtagcagtgaaatgcgtagagatcgggaggaacatctgtggcgaaggcggccatctggaccaacactgacactgaggcacgaaagcgtggggagcaaacaggattagataccctggtagtccacgccctaaacgatgcgaactggatgttgggtgcaacttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggtcttgacatccacggaactttccagagatggattggtgccttcgggaaccgtgagacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacgaccagggctacacacgtactacaatggtggggacagagggctgcaagccggcgacggtaagccaatcccagaaaccccatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgctgccacgg

SEQ ID NO: 844 - DNA, 1406 bp, Curtobacterium sp.
taccatgcagtcgaacggtaacaggtcttcggatgctgacgagtggcgaacgggtgagtaatacatcggaacgtgcccgatcgtgggggataacgaggcgaaagctttgctaataccgcataagatctatggatgaaagcaggggaccgcaaggccttgcgcgaacggagcggccgatggcagattaggtagttggtggggtaaaggcttaccaagcctacgatctgtagctggtctgagaggacgaccagccacactgggactgagacacggcccagactcctacgggaggcagcagtggggaattttggacaatgggcgcaagcctgatccagccatgccgcgtgcaggatgaaggccttcgggttgtaaactgcttttgtacggaacgaaaagccttcttctaataaagggaggtcatgacggtaccgtaagaataagcaccggctaactacgtgccagcagccgcggtaatacgtagggtgcaagcgttaatcggaattactgggcgtaaagcgtgcgcaggcggtgatgtaagacagatgtgaaatccccgggctcaacctgggaactgcatttgtgactgcatcgctggagtacggcagagggggatggaattccgcgtgtagcagtgaaatgcgtagatatgcggaggaacaccgatggcgaaggcaatcccctgggcctgtactgacgctcatgcacgaaagcgtggggagcaaacaggattagataccctggtagtccacgccctaaacgatgtcaactggttgttgggtcttcactgactcagtaacgaagctaacgcgtgaagttgaccgcctggggagtacggccgcaaggttgaaactcaaaggaattgacggggacccgcacaagcggtggatgatgtggtttaattcgatgcaacgcgaaaaaccttacccacctttgacatgtacggaatcctttagagatagaggagtgctcgaaagagaaccgtaacacaggtgctgcatggctgtcgtcagctcgtgtcgtgagatgttgggttaagtcccgcaacgagcgcaacccttgccattagttgctacgaaagggcactctaatgggactgccggtgacaaaccggaggaaggtggggatgacgtcaagtcctcatggcccttataggtggggctacacacgtcatacaatggctggtacagagggttgccaacccgcgagggggagctaatcccataaagccagtcgtagtccggatcgcagtctgcaactcgactgcgtgaagtcggaatcgctagtaatcgcggatcagaatgtcgcggtgaatacgttcccgggtcttgtacacaccgcccgtcacaccatgggagcgggttctgccagaagtaggtagcctaaccgtaaggagggcgctaccacta

SEQ ID NO: 845 - DNA, 1360 bp, Xanthomonas sp.
atagcagtcgaacgatgctttcgggcatagtggcgcacgggtgcgtaacgcgtgggaatctgcccttgggtctgggataacagttggaaacgactgctaataccggatgatatcgcgagatcaaagatttatcgcccgaggatgagcccgcgtaggattagctagttggtggggtaaaggcctaccaaggcgacgatccttagctggtctgagaggatgatcagccacactgggactgagacacggcccagactcctacgggaggcagcagtggggaatattggacaatgggcgcaagcctgatccagcaatgccgcgtgagtgatgaaggccttagggttgtaaagctcttttacccgggatgataatgacagtaccgggagaataagccccggctaactccgtgccagcagccgcggtaatacggagggggctagcgttgttcggaattactgggcgtaaagcgcacgtaggcggctttgtaagtcaggggtgaaagcctggagctcaactccagaactgcctttgagactgcatcgcttgaatccgggagaggtaagtggaattccgagtgtagaggtgaaattcgtagatattcggaagaacaccagtggcgaaggcggcttactggaccgggattgacgctgaggtgcgaaagcgtggggagcaaacaggattagataccctggtagtccacgccgtaaacgatgataactagctgtccggggacttggtctttgggtggcgcagctaacgcattaagttatccgcctggggagtacggccgcaaggttaaaactcaaaggaattgacgggggcctgcacaagcggtggagcatgtggtttaattcgaagcaacgcgcagaaccttaccagcgtttgacatgtccggacgatttccagagatggatctcttcccttcggggactgggaacacaggtgctgcatggctgtcgtcagctcgtgtcgtgagatgttgggttaagtcccgcaacgagcgcaaccctcgcctttagttaccatcatttggttgggtactctaaaggaaccgccggtgataagccggaggaaggtggggatgacgtcaagtcctcatggcccttacgcgctgggctacacacgtgctacaatggcgactacagtgggctgcaatcccgcgagggtgagctaatctccaaaagtcgtctcagttcggattgttctctgcaactcgagagcatgaaggcggaatcgctagtaatcgcggatcagcatgccgcggtgaatacgttcccaggccttgtacacaccgcccgtcacaccatgggagttgggttcacccgaaggcgttgcgctaacctcgcaagaggaggcaggcgac

SEQ ID NO: 846 - DNA, 1406 bp, Enterobacteriaceae
acatgcaagtcgagcggatgagaggagcttgctcttcgattcagcggcggacgggtgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccttcgggtcgtaaagcactttaagttgggaggaagggctcatagcgaatacctgtgagttttgacgttaccaacagaataagcaccggctaacttcgtgccagcagccgcggtaatacgaagggtgcaagcgttaatcggaattactgggcgtaaagcgcgcgtaggtggcttgataagttggatgtgaaatccccgggctcaacctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccctcgggaggactct

SEQ ID NO: 847 - DNA, 1365 bp, Curtobacterium sp.
cacatgcagtcgaacgaaggcttcggccttagtggcgcacgggtgcgtaacgcgtgggaatctgccctttggttcggaataacagctggaaacggctgctaataccggatgatgacgaaagtccaaagatttatcgccagaggatgagcccgcgttggattaggtagttggtggggtaaaggcctaccaagccgacgatccatagctggtctgagaggatgatcagccacactgggactgagacacggcccagactcctacgggaggcagcagtggggaatattggacaatgggcgaaagcctgatccagcaatgccgcgtgagtgatgaaggccctagggttgtaaagctcttttacccgggaagataatgactgtaccgggagaataagcccccggctaactccgtgccagcagccgcggtaatacggagggggctagcgttgttcggaattactgggcgtaaagcgcacgtaggcggctttgtaagtcagaggtgaaagcctggagctcaactccagaactgcctttgagactgcatcgcttgaatccaggagaggtcagtggaattccgagtgtagaggtgaaattcgtagatattcggaagaacaccagtggcgaaggcggctgactggactggtattgacgctgaggtgcgaaagcgtggggagcaaacaggattagataccctggtagtccacgccgtaaacgatgataactagctgtccgggcacttggtgcttgggtggcgcagctaacgcattaagttatccgcctggggagtacggccgcaaggttaaaactcaaaggaattgacgggggcctgcacaagcggtggagcatgtggtttaattcgaagcaacgcgcagaaccttaccagcgtttgacatgtccggacgatttccagagatggatctcttcccttcggggactggtacacaggtgctgcatggctgtcgtcagctcgtgtcgtgagatgttgggttaagtcccgcaacgagcgcaaccctcgcctttagttaccatcatttggttgggtactctaaaggaaccgccggtgataagccggaggaaggtggggatgacgtcaagtcctcatggcccttacgcgctgggctacacacgtgctacaatggcaactacagtgggcagcgaccctgcgagggcgagctaatccccaaaagttgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgttgcgccaacccgcaagggaagcaggcgaccacgt

SEQ ID NO: 848 - DNA, 1383 bp, Enterobacteriaceae
tcgaacgatgatgcccagcttgctgggtggattagtggcgaacgggtgagtaacacgtgagtaacctgcccctgactctgggataagcgttggaaacgacgtctaatactggatatgatcactggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcatggggagcgaacaggattagataccctggtagtccatgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggtcgcccccttgtggtcggtgtacaggtggtgcatggttgtcgtcagctcgtgtcgtgagatgttgggttaagtcccgcaacgagcgcaaccctcgttctatgttgccagcgggttatgccggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagccg

SEQ ID NO: 849 - DNA, 1422 bp, Agrobacterium sp.
acacatgcagtcgaacggcagcacaggagagcttgctctctgggtggcgagtggcggacgggtgaggaatacatcggaatctaccttttcgtgggggataacgtagggaaacttacgctaataccgcatacgaccttagggtgaaagcggaggaccttcgggcttcgcgcggatagatgagccgatgtcggattagctagttggcggggtaaaggcccaccaaggcgacgatccgtagctggtctgagaggatgatcagccacactggaactgagacacggtccagactcctacgggaggcagcagtggggaatattggacaatgggcgcaagcctgatccagccatgccgcgtgggtgaagaaggccttcgggttgtaaagcccttttgttgggaaagaaaagcagtcggttaatacccgattgttctgacggtacccaaagaataagcaccggctaacttcgtgccagcagccgcggtaatacgaagggtgcaagcgttactcggaattactgggcgtaaagcgtgcgtaggtggttgtttaagtccgttgtgaaagccctgggctcaacctgggaattgcagtggatactgggcaactagagtgtggtagaggatggcggaattcccggtgtagcagtgaaatgcgtagagatcgggaggaacatctgtggcgaaggcggccatctggaccaacactgacactgaggcacgaaagcgtggggagcaaacaggattagataccctggtagtccacgccctaaacgatgcgaactggatgttgggtgcaacttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggtcttgacatccacggaactttccagagatggattggtgccttcgggaaccgtgagacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacgaccagggctacacacgtactacaatggtagggacagagggctgcaagccggcgacggtaagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgctgccacta

SEQ ID NO: 850 - DNA, 1299 bp, Curtobacterium sp.
tcagcggcggacgggtgagtaacgcgtggtaacgtgccttctggttcggaataaccctgggaaactagggctaataccggatacgcccttttggggaaaggtttactgccggaagatcggcccgcgtctgattagctagttggtggggtaacggcctaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctcttttatccgggacgataatgacggtaccggaggaataagccccggctaacttcgtgccagcagccgcggtaatacgaagggggctagcgttgctcggaatcactgggcgtaaagggcgcgtaggcggcgttttaagtcgggggtgaaagcctgtggctcaaccacagaatggccttcgatactgggacgcttgagtatggtagaggttggtggaactgcgagtgtagaggtgaaattcgtagatattcgcaagaacaccggtggcgaaggcggccaactggaccattactgacgctgaggcgcgaaagcgtggggagcaaacaggattagataccctggtagtccacgccgtaaacgatgaatgccagctgttggggtgcttgcaccgcagtagcgcagctaacgctttgagcattccgcctggggagtacggtcgcaagattaaaactcaaaggaattgacgggggcccgcacaagcggtggagcatgtggtttaattcgaagcaacgcgcagaaccttaccatcctttgacatggcgtgttacccagagagatctggggtccccttcgggggcgcgcacacaggtgctgcatggctgtcgtcagctcgtgtcgtgagatgttgggttaagtcccgcaacgagcgcaacccacgtccttagttgccatcattcagttgggcactctagggagactgccggtgataagccgcgaggaaggtgtggatgacgtcaagtcctcatggcccttacgggatgggctacacacgtgctacaatggcggtgacagtgggaggcgaaggagcgatctggagcaaatccccaaaagccgtctcagttcggattgcactctgcaactcgagtgcatgaaggcggaatcgctagtaatcgtggatcagcatgccacggtgaatacgttcccgggccttgtacacaccgcccgtcacaccatgggagttggtcttacccgacggcg

SEQ ID NO: 851 - DNA, 1337 bp, Enterobacteriaceae
gacagtcgagcgggcccttcggggtcagcggcggacgggtgagtaacgcgtgggaacgtgccttctggttcggaataaccctgggaaactagggctaataccggatacgcccttttggggaaaggtttactgccggaagatcggcccgcgtctgattagctagttggtggggtaacggcctaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctcttttatccgggacgataatgacggtaccggaggaataagccccggctaacttcgtgccagcagccgcggtaatacgaagggggctagcgttgctcggaatcactgggcgtaaagggcgcgtaggcggcgttttaagtcgggggtgaaagcctgtggctcaaccacagaatggccttcgatactgggacgcttgagtatggtagaggttggtggaactgcgagtgtagaggtgaaattcgtagatattcgcaagaacaccggtggcgaaggcggccaactggaccattactgacgctgaggcgcgaaagcgtggggagcaaacaggattagataccctggtagtccacgccgtaaacgatgaatgccagctgttggggtgcttgcaccgcagtagcgcagctaacgctttgagcattccgcctggggagtacggtcgcaagattaaaactcaaaggaattgacgggggcccgcacaagcggtggagcatgtggtttaattcgaagcaacgcgcagaaccttaccatcctttgacatggcgtgttacccagagagatctggggtccccttcgggggcgcgcacacaggtgctgcatggctgtcgtcagctcgtgtcgtgagatgttgggttaagtcccgcaacgagcgcaacccacgtccttagttgccatcattcagttgggcactctagggagactgccggtgataagccgcgaggaaggtgtggatgacgtcaagtcctcatggcccttacgggatgggctacacacgtgctacaatggcggtgacagtgggaggcgaaggagcgatctggagcaaatccccaaaagccgtctcagttcggattgcactctgcaactcgagtgcatgaaggcggaatcgctagtaatcgtggatcagcatgccacggtgaatacgttcccgggccttgtacacaccgcccgtcacaccatgggagttggtcttacccgacggcgctgcgccaacctgc

SEQ ID NO: 852 - DNA, 1397 bp, Methylobacterium sp.
accatgcaagtcgaacggtgaagccaagcttgcttggtggatcagtggcgaacgggtgagtaacacgtgagcaacctgccctggactctgggataagcgctggaaacggcgtctaatactggatatgagctcctatcgcatggtgggggttggaaagatttttcggtctgggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcggaagcctgatgcagcaacgccgcgtgagggatgacggccttcgggttgtaaacctcttttagcagggaagaagcgagagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatcccgaggctcaacctcgggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggaccattccacggtttccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaaggcttgacatacatcagaacaccgtagaaatacgggactctttggacactggtgaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcccaacccttgtggagggagccgtcg

SEQ ID NO: 853 - DNA, 1356 bp, Enterobacteriaceae
catgcagtcgagcgggcccttcggggtcagcggcggacgggtgagtaacgcgtgggaacgtgccttctggttcggaataaccctgggaaactagggctaataccggatacgcccttttggggaaaggtttactgccggaagatcggcccgcgtctgattagctagttggtggggtaacggcctaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctcttttatccgggacgataatgacggtaccggaggaataagccccggctaacttcgtgccagcagccgcggtaatacgaagggggctagcgttgctcggaatcactgggcgtaaagggcgcgtaggcggcgttttaagtcgggggtgaaagcctgtggctcaaccacagaatggcctttcgatactgggacgcttgagtatggtagaggttggtggaactgcgagtgtagaggtgaaattcgtagatattcgcaagaacaccggtggcgaaggcggccaactggaccattactgacgctgaggcgcgaaagcgtggggagcaaacaggattagataccctggtagtccacgccgtaaacgatgaatgccagctgttggggtgcttgcaccgcagtagcgcagctaacgctttgagcattccgcctggggagtacggtcgcaagattaaaactcaaaggaattgacgggggcccgcacaagcggtggagcatgtggtttaattcgaagcaacgcgcagaaccttaccatcctttgacatggcgtgttacccagagagatctggggtccccttcgggggcgcgcacacaggtgctgcatggctgtcgtcagctcgtgtcgtgagatgttgggttaagtcccgcaacgagcgcaacccacgtccttagttgccatcattcagttgggcactctagggagactgccggtgataagccgcgaggaaggtgtggatgacgtcaagtcctcatggcccttacgggatgggctacacacgtgctacaatggcggtgacagtgggaggcgaaggagcgatctggagcaaatccccaaaagccgtctcagttcggattgcactctgcaactcgagtgcatgaaggcggaatcgctagtaatcgtggatcagcatgccacggtgaatacgttcccgggccttgtacacaccgcccgtcacaccatgggagttggtcttacccgacggcgctgcgccaaccgcaaggaggcaggcgtcca

SEQ ID NO: 854 - DNA, 1362 bp, Xanthomonas sp.
ccatgcagtcgaacgcatcgcaagatgagtggcagacgggtgagtaacgcgtgggaacatacccttttctacggaatagctctgggaaactggaattaataccgtatacgccctacgggggaaagatttatcggggaaggattggcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctctttcaccgatgaagataatgacggtagtcggagaagaagccccggctaacttcgtgccagcagccgcggtaatacgaagggggctagcgttgttcggaattactgggcgtaaagcgcacgtaggcggatatttaagtcaggggtgaaatcccagagctcaactctggaactgcctttgatactgggtatcttgagtatggaagaggtaagtggaattgcgagtgtagaggtgaaattcgtagatattcgcaggaacaccagtggcgaaggcggcttactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagctcttgacattcggggtatggtcattggagacgatgaccttcagttcggctggccctagaacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagacagcgatgtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttttacccgaaggcgctgcgctaaccgcaagggggcaggcgaccactgt

SEQ ID NO: 855 - DNA, 1411 bp, Acidovorax sp.
cacatgcagtcggacggtagcacagagagagcttgctcctcgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaacggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgaggttaataaccttactgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtagttagcttaaccttcgggagggcgc

SEQ ID NO: 856 - DNA, 1412 bp, Sphingomonas sp.
acatgcagtcgagcggatgagaggagcttgctcctcgattcagcggcggacgggtgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccctcgggtcgtaaagcactttaagttgggaggaagggctcatagcgaatacctgtgagttttgacgttaccaacagaataagcaccggctaacttcgtgccagcagccgcggtaatacgaagggtgcaagcgttaatcggaattactgggcgtaaagcgcgcgtaggtggcttgataagttggatgtgaaatccccgggctcaacctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccttcgggaggacggtaccacta

SEQ ID NO: 857 - DNA, 1354 bp, Pseudomonas sp.
cagtcgagcgggcccttcggggtcagcggcggacgggtgagtaacgcgtgggaacgtgccttctggttcggaataaccctgggaaactagggctaataccggatacgcccttttggggaaaggtttactgccggaagatcggcccgcgtctgattagctagttggtggggtaacggcctaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctcttttatccgggacgataatgacggtaccggaggaataagccccggctaacttcgtgccagcagccgcggtaatacgaaggggggctagcgttgctcggaatcactgggcgtaaagggcgcgtaggcggcgttttaagtcgggggtgaaagcctgtggctcaaccacagaatggcctttcgatactgggacgcttgagtatggtagaggttggtggaactgcgagtgtagaggtgaaattcgtagatattcgcaagaacaccggtggcgaaggcggccaactggaccattactgacgctgaggcgcgaaagcgtggggagcaaacaggattagataccctggtagtccacgccgtaaacgatgaatgccagctgttggggtgcttgcaccgcagtagcgcagctaacgctttgagcattccgcctggggagtacggtcgcaagattaaaactcaaaggaattgacgggggcccgcacaagcggtggagcatgtggtttaattcgaagcaacgcgcagaaccttaccatcctttgacatggcgtgttacccagagagatctggggtccccttcgggggcgcgcacacaggtgctgcatggctgtcgtcagctcgtgtcgtgagatgttgggttaagtcccgcaacgagcgcaacccacgtccttagttgccatcattcagttgggcactctagggagactgccggtgataagccgcgaggaaggtgtggatgacgtcaagtcctcatggcccttacgggatgggctacacacgtgctacaatggcggtgacagtgggaggcgaaggagcgatctggagcaaatccccaaaagccgtctcagttcggattgcactctgcaactcgagtgcatgaaggcggaatcgctagtaatcgtggatcagcatgccacggtgaatacgttcccgggccttgtacacaccgcccgtcacaccatgggagttggtcttacccgacggcgctgcgccaaccgcaaggaggcaggcgaccac

SEQ ID NO: 858 - DNA, 1403 bp, Sphingomonas sp.
cgcatgcagtcgaacggcagcacgggtgcttgcacctggtggcgagtggcgaacgggtgagtaatacatcggaacatgtcctgtagtgggggatagcccggcgaaagccggattaataccgcatacgatctacggaagaaagcgggggaccttcgggcctcgcgctatagggttggccgatggctgattagctagttggtggggtaaaggcctaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatcctgagggctaatatccttcggggatgacggtaccggaagaataagcaccggctaactacgtgccagcagccgcggtaatacgtagggtgcgagcgttaatcggaattactgggcgtaaagcgtgcgcaggcggtttgctaagaccgatgtgaaatccccgggctcaacctgggaactgcattggtgactggcaggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctgaggagactcgggagtgctcgaaagagaaccgatacacaggtgctgcatggctgtcgtcagctcgtgtcgtgagatgttgggttaagtcccgcaacgagcgcaacccttgtccttagttgctacgcaagagcactctaaggagactgccggtgacaaaccggaggaaggtggggatgacgtcaagtcctcatggcccttatgggtagggcttcacacgtcatacaatggtcggaacagagggttgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtc

SEQ ID NO: 859 - DNA, 1411 bp, Curtobacterium sp.
acatgcagtcggacggtagcacagagaagcttgctcctcgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaatggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgaggttaataaccttgtcgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaaccctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtagttagcttaacctccgggagggcgct

SEQ ID NO: 860 - DNA, 1395 bp, Xanthomonas sp.
cagtcgaacggcagcacgggtgcttgcacctggtggcgagtggcgaacgggtgagtaatacatcggaacatgtcctgtagtgggggatagcccggcgaaagccggattaataccgcatacgatctacggaagaaagcgggggaccttcgggcctcgcgctatagggttggccgatggctgattagctagttggtggggtaaaggcctaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatcctgagggctaatatccttcggggatgacggtaccggaagaataagcaccggctaactacgtgccagcagccgcggtaatacgtagggtgcgagcgttaatcggaattactgggcgtaaagcgtgcgcaggcggtttgctaagaccgatgtgaaatccccgggctcaacctgggaactgcattggtgactggcaggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctgaggagactcgggagtgctcgaaagagaaccgatacacaggtgctgcatggctgtcgtcagctcgtgtcgtgagatgttgggttaagtcccgcaacgagcgcaacccttgtccttagttgctacgcaagagcactctaaggagactgccggtgacaaaccggaggaaggtggggatgacgtcaagtcctcatggcccttatgggtagggcttcacacgtcatacaatggtcggaacagagggttgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacgg

SEQ ID NO: 861 - DNA, 1391 bp, Methylobacterium sp.
acatgcagtcgacgatgaagcccagcttgctgggtggattagtggcgaacgggtgagtaacacgtgagtaacctgcccctgactctgggataagcgttggaaacgacgtctaatactggatatgactactggtcgcatggcctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaatttcgatgcaacgcgaagaaccttaccaaggcttgacatacaccggaaacggccagagatggtcgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagccg

SEQ ID NO: 862 - DNA, 1401 bp, Methylobacterium sp.
gcagtcgaacggcagcacgggtgcttgcacctggtggcgagtggcgaacgggtgagtaatacatcggaacatgtcctgtagtgggggatagcccggcgaaagccggattaataccgcatacgatctacggaagaaagcgggggaccttcgggcctcgcgctatagggttggccgatggctgattagctagttggtggggtaaaggcctaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatcctgagggctaatatccttcggggatgacggtaccggaagaataagcaccggctaactacgtgccagcagccgcggtaatacgtaggggtgcgagcgttaatcggaattactgggcgtaaagcgtgcgcaggcggtttgctaagaccgatgtgaaatccccgggctcaacctgggaactgcattggtgactggcaggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctgaggagactcgggagtgctcgaaagagaaccgatacacaggtgctgcatggctgtcgtcagctcgtgtcgtgagatgttgggttaagtcccgcaacgagcgcaacccttgtccttagttgctacgcaagagcactctaaggagactgccggtgacaaaccggaggaaggtggggatgacgtcaagtcctcatggcccttatgggtagggcttcacacgtcatacaatggtcggaacagagggttgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcac

SEQ ID NO: 863 - DNA, 1369 bp, Microbacterium sp.
acacatgcagtcgaacgaaggcttcggccttagtggcgcacgggtgcgtaacgcgtgggaatctgccctttggttcggaataacagctggaaacggctgctaataccggatgatgacgaaagtccaaagatttatcgccagaggatgagcccgcgttggattaggtagttggtggggtaaaggcctaccaagccgacgatccatagctggtctgagaggatgatcagccacactgggactgagacacggcccagactcctacgggaggcagcagtggggaatattggacaatgggcgaaagcctgatccagcaatgccgcgtgagtgatgaaggccctagggttgtaaagctcttttacccgggaagataatgactgtaccgggagaataagccccggctaactccgtgccagcagccgcggtaatacggagggggctagcgttgttcggaattactgggcgtaaagcgcacgtaggcggctttgtaagtcagaggtgaaagcctggagctcaactccagaactgcctttgagactgcatcgcttgaatccaggagaggtcagtggaattccgagtgtagaggtgaaattcgtagatattcggaagaacaccagtggcgaaggcggctgactggactggtattgacgctgaggtgcgaaagcgtggggagcaaacaggattagataccctggtagtccacgccgtaaacgatgataactagctgtccgggcacttggtgcttgggtggcgcagctaacgcattaagttatccgcctggggagtacggccgcaaggttaaaactcaaaggaattgacgggggcctgcacaagcggtggagcatgtggtttaattcgaagcaacgcgcagaaccttaccagcgtttgacatgtccggacgatttccagagatggatctcttcccttcggggactggaacacaggtgctgcatggctgtcgtcagctcgtgtcgtgagatgttgggttaagtcccgcaacgagcgcaaccctcgcctttagttaccatcatttggttgggtactctaaaggaaccgccggtgataagccggaggaaggtggggatgacgtcaagtcctcatggcccttacgcgctgggctacacacgtgctacaatggcaactacagtgggcagcgaccctgcgagggcgagctaatccccaaaagttgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgttgcgccaacccgcaagggaagcaggcgaccacggtgtc

SEQ ID NO: 864 - DNA, 1398 bp, Methylobacterium sp.
cgaacggcagcacggacttcggtctggtggcgagtggcgaacgggtgagtaatgtatcggaacgtgcccagtagcgggggataactacgcgaaagcgtagctaataccgcatacgccctacgggggaaagcaggggatcgtaagaccttgcactattggagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggttaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagcttaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttggtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaatgccgaagagatttggcagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgataccacggt

SEQ ID NO: 865 - DNA, 1415 bp, Agrobacterium sp.
gcagtcgaacggcagcacaggagagcttgctctctgggtggcgagtggcggacgggtgaggaatacatcggaatctaccttttcgtgggggataacgtagggaaacttacgctaataccgcatacgaccttagggtgaaagcggaggaccttcgggcttcgcgcggatagatgagccgatgtcggattagctagttggcggggtaaaggcccaccaaggcgacgatccgtagctggtctgagaggatgatcagccacactggaactgagacacggtccagactcctacgggaggcagcagtggggaatattggacaatgggcgcaagcctgatccagccatgccgcgtgggtgaagaaggccttcgggttgtaaagcccttttgttgggaaagaaaagcagtcggttaatacccgattgttctgacggtacccaaagaataagcaccggctaacttcgtgccagcagccgcggtaatacgaagggtgcaagcgttactcggaattactgggcgtaaagcgtgcgtaggtggttgtttaagtccgttgtgaaagccctgggctcaacctgggaattgcagtggatactgggcaactagagtgtggtagaggatggcggaattcccggtgtagcagtgaaatgcgtagagatcgggaggaacatctgtggcgaaggcggccatctggaccaacactgacactgaggcacgaaagcgtggggagcaaacaggattagataccctggtagtccacgccctaaacgatgcgaactggatgttgggtgcaacttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggtcttgacatccacggaactttccagagatggattggtgccttcgggaaccgtgagacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacgaccagggctacacacgtactacaatggtagggacagagggctgcaagccggcgacggtaagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgctgccacg

SEQ ID NO: 866 - DNA, 1402 bp, Enterobacteriaceae
tcgaacggcagcacggacttcggtctggtggcgagtggcgaacgggtgagtaatgtatcggaacgtgcctagtagcgggggataactacgcgaaagcgtagctaataccgcatacgccctacgggggaaagcaggggatcgcaagaccttgcactattagagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggctaataccccgtgaaactgacggtacctgcagaataagcaccggctaactacgtgccagcagccgcggtaatacgtagggtgcaagcgttaatcggaattactgggcgtaaagcgtgcgcaggcgggttcggaaagaaagatgtgaaatcccagagctcaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttagtagcgcagctaacgcgtgaagttgaccgcctggggagtacggtcgcaagattaaaactcaaaggaattgacggggacccgcacaagcggtgggatgatgtggattaattcgatgcaacgcgaaaaaccttacctacccttgacatgtctggaattccgaagagatttggaagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgataccactgta

SEQ ID NO: 867 - DNA, 1407 bp, Pseudomonas sp.
gcatgcagtcgaacggcagcacggacttcggtctggtggcgagtggcgaacgggtgagtaatgtatcggaacgtgcctagtagcgggggataactacgcgaaagcgtagctaataccgcatacgccctacgggggaaagcaggggatcgcaagaccttgcactattagagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggctaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagctcaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttagtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaattccgaagagatttggaagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgataccactag

SEQ ID NO: 868 - DNA, 1378 bp, Methylobacterium sp.
ccatgcagtcgacgatgatcaggagcttgctcttgtgattagtggcgaacgggtgagtaacacgtgagtaacctgcccctgactctgggataagcgttggaaacgacgtctaatactggataggactactggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcatggggagcgaacaggattagataccctggtagtccatgccgtaaacgttgggcgctagatgtagggacctttccacggtttctgtgtcgtagctaacgcattaagcgccccgcctggggagtacgggcgcaaggctaaaactcaaaggaattgacgggggcccgcacaagcggcggagcatgcggattaattcgatgcaacgcgaagaaccttaccaaggcttgacatacaccggaaacggccagagatggtcgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttg

SEQ ID NO: 869 - DNA, 1409 bp, Burkholderia sp.
gcagtcgagcggatgagaggagcttgctcctcgattcagcggcggacgggtgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccttcgggtcgtaaagcactttaagttgggaggaagggctcatagcgaatacctgtgagttttgacgttaccaacagaataagcaccggctaacttcgtgccagcagccgcggtaatacgaagggtgcaagcgttaatcggaattactgggcgtaaagcgcgcgtaggtggcttgataagttggatgtgaaatccccgggctcaacctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccctcgggaggacggtaccactga

SEQ ID NO: 870 - DNA, 1371 bp, Erwinia sp.
gcagtcgacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaatactcaaaggaattgacgggggcccgcacaagcggcggagcatgcggattaattcgatgcaacgcgaagaaccttaccaaggcttgacatacaccggaaacagccagagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaaccc

SEQ ID NO: 871 - DNA, 1424 bp, Burkholderia sp.
acatgcagtcgaacggcagcaacaggagagcttgctctctgggtggcgagtggcggacgaggtgaggaatacatcggaatctaccttttcgtgggggataacgtagggaaacttacgctaataccgcatacgaccttagggtgaaagcggaggaccttcgggcttcgcgcggatagatgagccgatgtcggattagctagttggcggggtaaaggcccaccaaggcgacgatccgtagctggtctgagaggatgatcagccacactggaactgagacacggtccagactcctacgggaggcagcagtggggaatattggacaatgggcgcaagcctgatccagccatgccgcgtgggtgaagaaggccttcgggttgtaaagcccttttgttgggaaagaaaagcagtcggttaatacccgattgttctgacggtacccaaagaataagcaccggctaacttcgtgccagcagccgcggtaatacgaagggtgcaagcgttactcggaattactgggcgtaaagcgtgcgtaggtggttgtttaagtccgttgtgaaagccctgggctcaacctgggaattgcagtggatactgggcaactagagtgtggtagaggatggcggaattcccggtgtagcagtgaaatgcgtagagatcgggaggaacatctgtggcgaaggcggccatctggaccaacactgacactgaggcacgaaagcgtggggagcaaacaggattagataccctggtagtccacgccctaaacgatgcgaactggatgttgggtgcaacttggcacgcagtatcgaagctaacgcgttaagttcgccgcctggggagtacggtcgcaagactgaaactcaaaggaattgacgggggcccgcacaagcggtgggagtatgtggtttaattcgatgcaacgcgaagaaccttacctggtcttgacatccacggaactttccagagatggattggtgccttcgggaaccgtgagacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacgaccagggctacacacgtactacaatggtagggacagagggctgcaagccggcgacggtaagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgctgccacggt

SEQ ID NO: 872 - DNA, 1350 bp, Curtobacterium sp.
agcagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgt

SEQ ID NO: 873 - DNA, 1397 bp, Burkholderia sp.
cagtcgaacggcagcacggacttcggtctggtggcgagtggcgaacgggtgagtaatgtatcggaacgtgcctagtagcgggggataactacgcgaaagcgtagctaataccgcatacgccctacgggggaaagcaggggatcgcaagaccttgcactattagagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggctaataccccgtgaaactgacggtacctgcagaataagcaccggctaactacgtgccagcagccgcggtaatacgtagggtgcaagcgttaatcggaattactgggcgtaaagcgtgcgcaggcgggttcggaaagaaagatgtgaaatcccagagctcaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttagtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaattccgaagagatttggaagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgatac

SEQ ID NO: 874 - DNA, 1409 bp, Sphingomonas sp.
atgcagtcgagcggatgagaggagcttgctcttcgattcagcggcggacgggtgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccttcgggtcgtaaagcactttaagttgggaggaagggctcatagcgaatacctgtgagttttgacgttaccaacagaataagcaccggctaacttcgtgccagcagccgcggtaatacgaagggtgcaagcgttaatcggaattactgggcgtaaagcgcgcgtaggtggcttgataagttggatgtgaaatccccgggctcaacctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccttcgggaggacggtaccact

SEQ ID NO: 875 - DNA, 1393 bp, Achromobacter sp.
cacatgcagtcgaacggtgaacacggagcttgctctgtgggatcagtggcgaacgggtgagtaacacgtgagcaacctgcccctgactctgggataagcgctggaaacggcgtctaatactggatatgtgacgtgatcgcatggtctgcgtctggaaagaatttcggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggacgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatccggaggctcaacctccggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtccattccacggattccgtgacgcagctaacgcattaagttcgccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcctaacccttgtggagggagcc

SEQ ID NO: 876 - DNA, 1362 bp, Xanthomonas sp.
aagcttgctcctcgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaatggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataacctcaccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatggtttggtgccttcgggaactctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtagtat

SEQ ID NO: 877 - DNA, 1403 bp, Achromobacter sp.
catgcagtcgagcggatgagaggagcttgctcctcgattcagcggcggacgggtgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccttcgggtcgtaaagcactttaagttgggaggaagggctcatagcgaatacctgtgagttttgacgttaccaacagaataagcaccggctaacttcgtgccagcagccgcggtaatacgaagggtgcaagcgttaatcggaattactgggcgtaaagcgcgcgtaggtggcttgataagttggatgtgaaatccccgggctcaacctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccctcgggaggacgg

SEQ ID NO: 878 - DNA, 1390 bp, Achromobacter sp.
gaacggcagcacgggtgcttgcacctggtggcgagtggcgaacgggtgagtaatacatcggaacatgtcctgtagtgggggatagcccggcgaaagccggattaataccgcatacgatctacggaagaaagcgggggaccttcgggcctcgcgctatagggttggccgatggctgattagctagttggtggggtaaaggcctaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatcctgagggctaatatccttcggggatgacggtaccggaagaataagcaccggctaactacgtgccagcagccgcggtaatacgtagggtgcgagcgttaatcggaattactgggcgtaaagcgtgcgcaggcggtttgctaagaccgatgtgaaatccccgggctcaacctgggaactgcattggtgactggcaggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctgaggagactcgggagtgctcgaaagagaaccgatacacaggtgctgcatggctgtcgtcagctcgtgtcgtgagatgttgggttaagtcccgcaacgagcgcaacccttgtccttagttgctacgcaagagcactctaaggagactgccggtgacaaaccggaggaaggtggggatgacgtcaagtcctcatggcccttatgggtagggcttcacacgtcatacaatggtcggaacagagggttgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacgc

SEQ ID NO: 879 - DNA, 1379 bp, Curtobacterium sp.
aagtcgagcggtaaggcctttcggggtacacgagcggcgaacgggtgagtaacacgtgggtgatctgccctgcacttcgggataagcctgggaaactgggtctaataccggatatgacctcctatcgcatggtgggtggtggaaagatttatcggtgcaggatgggcccgcggcctatcagcttgttggtggggtaatggcctaccaaggcgacgacgggtagccgacctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggacgaagcgcaagtgacggtacctgcagaagaagcaccggctaactacgtgccagcagccgcggtaatacgtagggtgcaagcgttgtccggaattactgggcgtaaagagttcgtaggcggtttgtcgcgtcgtttgtgaaaaccagcagctcaactgctggcttgcaggcgatacgggcagacttgagtactgcaggggagactggaattcctggtgtagcggtgaaatgcgcagatatcaggaggaacaccggtggcgaaggcgggtctctgggcagtaactgacgctgaggaacgaaagcgtgggtagcgaacaggattagataccctggtagtccacgccgtaaacggtgggcgctaggtgtgggttccttccacggaatccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggtttgacatataccggaaagctgcagagatgtggccccccttgtggtcggtatacaggtggtgcatggctgtcgtcagctcgtgtcgtgagatgttgggttaagtcccgcaacgagcgcaacccctatcttatgttgccagcacgttatggtggggactcgtaagagactgccggggtcaactcggaggaaggtggggacgacgtcaagtcatcatgccccttatgtccagggcttcacacatgctacaatggccagtacagagggctgcgagaccgtgaggtggagcgaatcccttaaagctggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggcttaaccccttgtgggagggag

SEQ ID NO: 880 - DNA, 1383 bp, Pseudomonas sp.
gacagtcgagcggtaaggcctttcggggtacacgagcggcgaacgggtgagtaacacgtgggtgatctgccctgcacttcgggataagcctgggaaactgggtctaataccggatatgacctcctatcgcatggtgggtggtggaaagatttatcggtgcaggatgggcccgcggcctatcagcttgttggtggggtaatggcctaccaaggcgacgacgggtagccgacctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggacgaagcgcaagtgacggtacctgcagaagaagcaccggctaactacgtgccagcagccgcggtaatacgtagggtgcaagcgttgtccggaattactgggcgtaaagagttcgtaggcggtttgtcgcgtcgtttgtgaaaaccagcagctcaactgctggcttgcaggcgatacgggcagacttgagtactgcaggggagactggaattcctggtgtagcggtgaaatgcgcagatatcaggaggaacaccggtggcgaaggcgggtctctgggcagtaactgacgctgaggaacgaaagcgtgggtagcgaacaggattagataccctggtagtccacgccgtaaacggtgggcgctaggtgtgggttccttccacggaatccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggtttgacatataccggaaagctgcagagatgtggccccccttgtggtcggtatacaggtggtgcatggctgtcgtcagctcgtgtcgtgagatgttgggttaagtcccgcaacgagcgcaacccctatcttatgttgccagcacgttatggtggggactcgtaagagactgccggggtcaactcggaggaaggtggggacgacgtcaagtcatcatgccccttatgtccagggcttcacacatgctacaatggccagtacagagggctgcgagaccgtgaggtggagcgaatcccttaaagctggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggcttaaccccttgtgggagggagcc

SEQ ID NO: 881 - DNA, 1360 bp, Curtobacterium sp.
agcttgctcctcgggtgacgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagcttgtaggcggggtaacggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtggtgaggttaataacctcagcaattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagcgaactttccagagatggattggtgccttcgggaacgctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtagta

SEQ ID NO: 882 - DNA, 1384 bp, Xanthomonas sp.
gcagtcgagcggtaaggcctttcggggtacacgagcggcgaacgggtgagtaacacgtgggtgatctgccctgcacttcgggataagcctgggaaactgggtctaataccggatatgacctcctatcgcatggtgggtggtggaaagatttatcggtgcaggatgggcccgcggcctatcagcttgttggtggggtaatggcctaccaaggcgacgacgggtagccgacctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggacgaagcgcaagtgacggtacctgcagaagaagcaccggctaactacgtgccagcagccgcggtaatacgtagggtgcaagcgttgtccggaattactgggcgtaaagagttcgtaggcggtttgtcgcgtcgtttgtgaaaaccagcagctcaactgctggcttgcaggcgatacgggcagacttgagtactgcaggggagactggaattcctggtgtagcggtgaaatgcgcagatatcaggaggaacaccggtggcgaaggcgggtctctgggcagtaactgacgctgaggaacgaaagcgtgggtagcgaacaggattagataccctggtagtccacgccgtaaacggtgggcgctaggtgtgggttccttccacggaatccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggtttgacatataccggaaagctgcagagatgtggccccccttgtggtcggtatacaggtggtgcatggctgtcgtcagctcgtgtcgtgagatgttgggttaagtcccgcaacgagcgcaacccctatcttatgttgccagcacgttatggtggggactcgtaagagactgccggggtcaactcggaggaaggtggggacgacgtcaagtcatcatgccccttatgtccagggcttcacacatgctacaatggccagtacagagggctgcgagaccgtgaggtggagcgaatcccttaaagctggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggtcttaaccccttgtgggagggagccg

SEQ ID NO: 883 - DNA, 1355 bp, Ochrobactrum sp.
atagcaagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggagagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgacc

SEQ ID NO: 884 - DNA, 1383 bp, Achromobacter sp.
tgcagtcgagcggtaaggcctttcggggtacacgagcggcgaacgggtgagtaacacgtgggtgatctgccctgcacttcgggataagcctgggaaactgggtctaataccggatatgacctcctatcgcatggtgggtggtggaaagatttatcggtgcaggatgggcccgcggcctatcagcttgttggtggggtaatggcctaccaaggcgacgacgggtagccgacctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggacgaagcgcaagtgacggtacctgcagaagaagcaccggctaactacgtgccagcagccgcggtaatacgtagggtgcaagcgttgtccggaattactgggcgtaaagagttcgtaggcggtttgtcgcgtcgtttgtgaaaaccagcagctcaactgctggcttgcaggcgatacgggcagacttgagtactgcaggggagactggaattcctggtgtagcggtgaaatgcgcagatatcaggaggaacaccggtggcgaaggcgggtctctgggcagtaactgacgctgaggaacgaaagcgtgggtagcgaacaggattagataccctggtagtccacgccgtaaacggtgggcgctaggtgtgggttcctttccacggaatccgtgccgtagctaacgcattaagcgcccggcctggggagtacggccgcaaggctaaaactcaaaggaattgacgggggcccgcacaagcggcggagcatgtggattaattcgatgcaacgcgaagaaccttacctgggtttgacatataccggaaagctgcagagatgtggccccccttgtggtcggtatacaggtggtgcatggctgtcgtcagctcgtgtcgtgagatgttgggttaagtcccgcaacgagcgcaacccctatcttatgttgccagcacgttatggtggggactcgtaagagactgccggggtcaactcggaggaaggtggggacgacgtcaagtcatcatgccccttatgtccagggcttcacacatgctacaatggccagtacagagggctgcgagaccgtgaggtggagcgaatcccttaaagctggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggcttaaccccttgtgggagggagc

SEQ ID NO: 885 - DNA, 1363 bp, Pseudomonas sp.
ttaccatgcagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgcccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccactg

SEQ ID NO: 886 - DNA, 1390 bp, Microbacterium sp.
acatgcagtcgagcggtaaggcctttcggggtacacgagcggcgaacgggtgagtaacacgtgggtgatctgccctgcacttcgggataagcctgggaaactgggtctaataccggatatgacctcctatcgcatggtgggtggtggaaagatttatcggtgcaggatgggcccgcggcctatcagcttgttggtggggtaatggcctaccaaggcgacgacgggtagccgacctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggacgaagcgcaagtgacggtacctgcagaagaagcaccggctaactacgtgccagcagccgcggtaatacgtagggtgcaagcgttgtccggaattactgggcgtaaagagttcgtaggcggtttgtcgcgtcgtttgtgaaaaccagcagctcaactgctggcttgcaggcgatacgggcagacttgagtactgcaggggagactggaattcctggtgtagcggtgaaatgcgcagatatcaggaggaacaccggtggcgaaggcgggtctctgggcagtaactgacgctgaggaacgaaagcgtgggtagcgaacaggattagataccctggtagtccacgccgtaaacggtgggcgctaggtgtgggttccttccacggaatccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggtttgacatataccggaaagctgcagagatgtggccccccttgtggtcggtatacaggtggtgcatggctgtcgtcagctcgtgtcgtgagatgttgggttaagtcccgcaacgagcgcaacccctatcttatgttgccagcacgttatggtggggactcgtaagagactgccggggtcaactcggaggaaggtggggacgacgtcaagtcatcatgccccttatgtccagggcttcacacatgctacaatggccagtacagagggctgcgagaccgtgaggtggagcgaatcccttaaagctggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggcttaaccccttgtgggagggagccgtcg

SEQ ID NO: 887 - DNA, 1406 bp, Enterobacteriaceae
cgtacggtagcacagagagcttgctctcgggtgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgttgtggttaataaccgcagcaattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaactttgcagagatggtttggtgccttcgggaactctgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgagtagggctacacacgtgctacaatggcgcatacaaagagaagcgaactcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccactt

SEQ ID NO: 888 - DNA, 1345 bp, Pseudomonas sp.
tgcagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaacctgcaaggagg

SEQ ID NO: 889 - DNA, 1366 bp, Burkholderia sp.
agtcgagcggtaggcctttcggggtcacgagcggcgaacgggtgagtaacacgtgggtgatctgccctgcacttcgggataagcctgggaaactgggtctaataccggatatgacctcctatcgcatggtgggtggtggaaagatttatcggtgcaggatgggcccgcggcctatcagcttgttggtggggtaatggcctaccaaggcgacgacgggtagccgacctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggacgaagcgcaagtgacggtacctgcagaagaagcaccggctaactacgtgccagcagccgcggtaatacgtagggtgcaagcgttgtccggaattactgggcgtaaagagttcgtaggcggtttgtcgcgtcgtttgtgaaaaccagcagctcaactgctggcttgcaggcgatacgggcagacttgagtactgcaggggagactggaattcctggtgtagcggtgaaatgcgcagatatcaggaggaacaccggtggcgaaggcgggtctctgggcagtaactgacgctgaggaacgaaagcgtgggtagcgaacaggattagataccctggtagtccacgccgtaaacggtgggcgctaggtgtgggttccttccacggaatccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggtttgacatataccggaaagctgcagagatgtggccccccttgtggtcggtatacaggtggtgcatggctgtcgtcagctcgtgtcgtgagatgttgggttaagtcccgcaacgagcgcaacccctatcttatgttgccagcacgttatggtggggactcgtaagagactgccggggtcaactcggaggaaggtggggacgacgtcaagtcatcatgccccttatgtccagggcttcacacatgctacaatggccagtacagagggctgcgagaccgtgaggtggagcgaatcccttaaagctggtctcagttcggatcggggtctgcaactcgaccccgtgaagtcggagtcgctagtaatcgcagatcagcaacgctgcggtgaatacgttcccgggccttgtacacaccgcccgtcacgtcgtgaaagtcggtaacacccgaagccggtggcttaaccccttg

SEQ ID NO: 890 - DNA, 1343 bp, Rhodococcus sp.
cgtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcagggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaatactcaaaggaattgacgggggcccgcacaagcggtggagcatgtggtttaattcgaagcaacgcgcagaaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggc

SEQ ID NO: 891 - DNA, 1361 bp, Rhodococcus sp.
cacatgcaagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccacta

SEQ ID NO: 892 - DNA, 1365 bp, Pantoea sp.
taagcttgctcttcgggtgacgagtggcggacgggtgagtaatgtctgggaaactgcccgatggcgggggataactactggaaacggtagctaataccgcataacgtcgcaagaccaaagtgggggaccttcgggcctcacgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtaaggttaataaccttgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggctttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcgggtagtgccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtagatcagaatgctacggtgaatacgttcccgggccttgtacacaccgcccgtcacaccatgggagtgggttgcaaaagaagtagtaa

SEQ ID NO: 893 - DNA, 1351 bp, Rhodococcus sp.
agcagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgtc

SEQ ID NO: 894 - DNA, 1387 bp, Ochrobactrum sp.
actgcagtcgagcggtaaggcctttacggggtacacgagcggcgaacgggtgagtaacacgtgggtgatctgccctgcacttcgggataagcctgggaaactgggtctaataccggatatgacctcctatcgcatggtgggtggtggaaagatttatcggtgcaggatgggcccgcggcctatcagcttgttggtggggtaatggcctaccaaggcgacgacgggtagccgacctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggacgaagcgcaagtgacggtacctgcagaagaagcaccggctaactacgtgccagcagccgcggtaatacgtagggtgcaagcgttgtccggaattactgggcgtaaagagttcgtaggcggtttgtcgcgtcgtttgtgaaaaccagcagctcaactgctggcttgcaggcgatacgggcagacttgagtactgcaggggagactggaattcctggtgtagcggtgaaatgcgcagatatcaggaggaacaccggtggcgaaggcgggtctctgggcagtaactgacgctgaggaacgaaagcgtgggtagcgaacaggattagataccctggtagtccacgccgtaaacggtgggcgctaggtgtgggttccttccacggaatccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggtttgacatataccggaaagctgcagagatgtggccccccttgtggtcggtatacaggtggtgcatggctgtcgtcagctcgtgtcgtgagatgttgggttaagtcccgcaacgagcgcaacccctatcttatgttgccagcacgttatggtggggactcgtaagagactgccggggtcaactcggaggaaggtggggacgacgtcaagtcatcatgccccttatgtccagggcttcacacatgctacaatggccagtacagagggctgcgagaccgtgaggtggagcgaatcccttaaagctggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggtcttaaccccttgtgggagggagcc

SEQ ID NO: 895 - DNA, 1356 bp, Rhodococcus sp.
ctagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaagcaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccactgt

SEQ ID NO: 896 - DNA, 1388 bp, Ochrobactrum sp.
ccatgcagtcgagcggtaaggcctttcggggtacacgagcggcgaacgggtgagtaacacgtgggtgatctgccctgcacttcgggataagcctgggaaactgggtctaataccggatatgacctcctatcgcatggtgggtggtggaaagatttatcggtgcaggatgggcccgcggcctatcagcttgttggtggggtaatggcctaccaaggcgacgacgggtagccgacctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggacgaagcgcaagtgacggtacctgcagaagaagcaccggctaactacgtgccagcagccgcggtaatacgtagggtgcaagcgttgtcccggaattactgggcgtaaagagttcgtaggcggtttgtcgcgtcgtttgtgaaaaccagcagctcaactgctggcttgcaggcgatacgggcagacttgagtactgcaggggagactggaattcctggtgtagcggtgaaatgcgcagatatcaggaggaacaccggtggcgaaggcgggtctctgggcagtaactgacgctgaggaacgaaagcgtgggtagcgaacaggattagataccctggtagtccacgccgtaaacggtgggcgctaggtgtgggttccttccacggaatccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggtttgacatataccggaaagctgcagagatgtggccccccttgtggtcggtatacaggtggtgcatggctgtcgtcagctcgtgtcgtgagatgttgggttaagtcccgcaacgagcgcaacccctatcttatgttgccagcacgttatggtggggactcgtaagagactgccggggtcaactcggaggaaggtggggacgacgtcaagtcatcatgccccttatgtccagggcttcacacatgctacaatggccagtacagagggctgcgagaccgtgaggtggagcgaatcccttaaagctggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggcttaaccccttgtgggagggagccg

SEQ ID NO: 897 - DNA, 1355 bp, Rhodococcus sp.
atagcagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgtcca

SEQ ID NO: 898 - DNA, 1352 bp, Enterobacteriaceae
aagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccac

SEQ ID NO: 899 - DNA, 1383 bp, Ochrobactrum sp.
atgcagtcgagcggtaaggcctttcggggtacacgagcggcgaacgggtgagtaacacgtgggtgatctgccctgcacttcgggataagcctgggaaactgggtctaataccggatatgacctcctatcgcatggtgggtggtggaaagatttatcggtgcaggatgggcccgcggcctatcagcttgttggtggggtaatggcctaccaaggcgacgacgggtagccgacctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggacgaagcgcaagtgacggtacctgcagaagaagcaccggctaactacgtgccagcagccgcggtaatacgtagggtgcaagcgttgtccggaattactgggcgtaaagagttcgtaggcggtttgtcgcgtcgtttgtgaaaaccagcagctcaactgctggcttgcaggcgatacgggcagacttgagtactgcaggggagactggaattcctggtgtagcggtgaaatgcgcagatatcaggaggaacaccggtggcgaaggcgggtctctgggcagtaactgacgctgaggaacgaaagcgtgggtagcgaacaggattagataccctggtagtccacgccgtaaacggtgggcgctaggtgtgggttccttccacggaatccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggtttgacatataccggaaagctgcagagatgtggccccccttgtggtcggtatacaggtggtgcatggctgtcgtcagctcgtgtcgtgagatgttgggttaagtcccgcaacgagcgcaacccctatcttatgttgccagcacgttatggtggggactcgtaagagactgccggggtcaactcggaggaaggtggggacgacgtcaagtcatcatgccccttatgtccagggcttcacacatgctacaatggccagtacagagggctgcgagaccgtgaggtggagcgaatcccttaaagctggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggcttaaccccttgtgggagggagc

SEQ ID NO: 900 - DNA, 1389 bp, Rhodococcus sp.
cttgcagtcgagcggtaaggcctttcggggtacacgagcggcgaacgggtgagtaacacgtgggtgatctgccctgcacttcgggataagcctgggaaactgggtctaataccggatatgacctcctatcgcatggtgggtggtggaaagatttatcggtgcaggatgggcccgcggcctatcagcttgttggtggggtaatggcctaccaaggcgacgacgggtagccgacctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggacgaagcgcaagtgacggtacctgcagaagaagcaccggctaactacgtgccagcagccgcggtaatacgtagggtgcaagcgttgtccggaattactgggcgtaaagagttcgtaggcggtttgtcgcgtcgtttgtgaaaaaccagcagctcaactgctggcttgcaggcgatacgggcagacttgagtactgcaggggagactggaattcctggtgtagcggtgaaatgcgcagatatcaggaggaacaccggtggcgaaggcgggtctctgggcagtaactgacgctgaggaacgaaagcgtgggtagcgaacaggattagataccctggtagtccacgccgtaaacggtgggcgctaggtgtgggttccttccacggaatccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggtttgacatataccggaaagctgcagagatgtggccccccttgtggtcggtatacaggtggtgcatggctgtcgtcagctcgtgtcgtgagatgttgggttaagtcccgcaacgagcgcaacccctatcttatgttgccagcacgttatggtggggactcgtaagagactgccggggtcaactcggaggaaggtggggacgacgtcaagtcatcatgccccttatgtccagggcttcacacatgctacaatggccagtacagagggctgcgagaccgtgaggtggagcgaatcccttaaagctggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggcttaaccccttgtgggagggagccgtc

SEQ ID NO: 901 - DNA, 1389 bp, Ochrobactrum sp.
accatgcagtcgagcggtaaggcctttcggggtacacgagcggcgaacgggtgagtaacacgtgggtgatctgccctgcacttcgggataagcctgggaaactgggtctaataccggatatgacctcctatcgcatggtgggtggtggaaagatttatcggtgcaggatgggcccgcggcctatcagcttgttggtggggtaatggcctaccaaggcgacgacgggtagccgacctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggacgaagcgcaagtgacggtacctgcagaagaagcaccggctaactacgtgccagcagccgcggtaatacgtagggtgcaagcgttgtccggaattactgggcgtaaagagttcgtaggcggtttgtcgcgtcgtttgtgaaaaccagcagctcaactgctggcttgcaggcgatacgggcagacttgagtactgcaggggagactggaattcctggtgtagcggtgaaatgcgcagatatcaggaggaacaccggtggcgaaggcgggtctctgggcagtaactgacgctgaggaacgaaagcgtgggtagcgaacaggattagataccctggtagtccacgccgtaaacggtgggcgctaggtgtgggttccttccacggaatccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggtttgacatataccggaaagctgcagagatgtggccccccttgtggtcggtatacaggtggtgcatggctgtcgtcagctcgtgtcgtgagatgttgggttaagtcccgcaacgagcgcaacccctatcttatgttgccagcacgttatggtggggactcgtaagagactgccggggtcaactcggaggaaggtggggacgacgtcaagtcatcatgccccttatgtccagggcttcacacatgctacaatggccagtacagagggctgcgagaccgtgaggtggagcgaatcccttaaagctggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggcttaaccccttgtgggagggagccgt

SEQ ID NO: 902 - DNA, 1360 bp, Ochrobactrum sp.
catgcaagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccactgc

SEQ ID NO: 903 - DNA, 1418 bp, Erwinia sp.
cacatgcagtcggacggtagcacagaggagcttgctcctcgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaacggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcaatgaggttaataaccttactgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattcccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgctaccact

SEQ ID NO: 904 - DNA, 1434 bp, Ochrobactrum sp.
atacatgcagtcgagcggacttgcatgagaagcttgcttctcatgataggttagcggcggacgggtgagtaacacgtaggcaacctgccctcaagcttgggacaactaccggaaacggtagctaataccgaatagttgttttcttctcctgaagaaaactggaaagacggagcaatctgtcacttggggatgggcctgcggcgcattagctagttggtggggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaggtgacggtacctgagaagaaagccccggctaactacgtgccagcagccgcggtaatacgtagggggcaagcgttgtccggaattattgggcgtaaagcgcgcgcaggcggtcatttaagtctggtgtttaatcccggggctcaaccccggatcgcactggaaactgggtgacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgagtgctaggtgttagggggtttcgatacccttggtgccgaagttaacacattaagcactccgcctggggagtacaggtcgcaagactgaaactcaaaggaattgacggggacccgcacaagcagtggagtatgtggtttaattcgaagcaacgcgaagaaccttaccaggtcttgacatccctctgaccggtacagagatgtacctttccttcgggacagaggagacaggtggtgcatggttgtcgtcagctcgtgtcgtgagatgttgggttaagtcccgcaacgagcgcaacccttgatcttagttgccagcacttcgggtgggcactctaaggtgactgccggtgacaaaccggaggaaggtggggatgacgtcaaatcatcatgccccttatgacctgggctacacacgtactacaatggccggtacaacgggctgtgaagccgcgaggtggaacgaatcctaaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaaccgcaaggagccagccgccgatg

SEQ ID NO: 905 - DNA, 1425 bp, Rhodococcus sp.
gagcggacttgcatgagaagcttgcttctctgataggttagcggcggacgggtgagtaacacgtaggcaacctgccctcaagtttgggacaactaccggaaacggtagctaataccgaatagttgttttcttctcctgaagaaaactggaaagacggagcaatctgtcacttggggatgggcctgcggcgcattagctagttggtggggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaggtgacggtacctgagaagaaagccccggctaactacgtgccagcagccgcggtaatacgtagggggcaagcgttgtccggaattattgggcgtaaagcgcgcgcaggcggtcatttaagtctggtgtttaatcccggggctcaaccccggatcgcactggaaactgggtgacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgagtgctaggtgttaggggtttcgatacccttgggtgccgaagttaacacattaagcactccgcctggggagtacggtcgcaagactgaaactcaaaggaattgacggggacccgcacaagcagtggagtatgtggtttaattcgaagcaacgcgaagaaccttaccaggtcttgacatccctctgaccggtacagagatgtacctttccttcgggacagaggagacaggtggtgcatggttgtcgtcagctcgtgtcgtgagatgttgggttaagtcccgcaacgagcgcaacccttgatcttagttgccagcacttcgggtgggcactctaaggtgactgccggtgacaaaccggaggaaggtggggatgacgtcaaatcatcatgccccttatgacctgggctacacacgtactacaatggccggtacaacgggctgtgaagccgcgaggtggaacgaatcctaaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaaccgcaaggagccagccgccgaaggtgat

SEQ ID NO: 906 - DNA, 1393 bp, Ochrobactrum sp.
tgataggttagcggcggacgggtgagtaacacgtaggcaacctgccctcaagtttgggacaactaccggaaacggtagctaataccgaatagttgttttcttctcctgaagaaaactggaaagacggagcaatctgtcacttggggatgggcctgcggcgcattagctagttggtggggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaggtgacggtacctgagaagaaagccccggctaactacgtgccagcagccgcggtaatacgtagggggcaagcgttgtccggaattattgggcgtaaagcgcgcgcaggcggtcatttaagtctggtgtttaatcccggggctcaaccccggatcgcactggaaactgggtgacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgagtgctaggtgttagggggtttcgatacccttggtgccgaagttaacacattaagcactccgcctggggagtacggtcgcaagactgaaactcaaaggaattgacggggacccgcacaagcagtggagtatgtggtttaattcgaagcaacgcgaagaaccttaccaggtcttgacatccctctgaccggtacagagatgtacctttccttcgggacagaggagacaggtggtgcatggttgtcgtcagctcgtgtcgtgagatgttgggttaagtcccgcaacgagcgcaacccttgatcttagttgccagcacttcgggtgggcactctaaggtgactgccggtgacaaaccggaggaaggtggggatgacgtcaaatcatcatgccccttatgacctgggctacacacgtactacaatggccggtacaacgggctgtgaagccgcgaggtggaacgaatcctaaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaaccgcaaggagccagccgccgaaggtg

SEQ ID NO: 907 - DNA, 1407 bp, Rhodococcus sp.
agaagcttgcttctcatgataggttagcggcggacgggtgagtaacacgtaggcaacctgccctcaagtttgggacaactaccggaaacggtagctaataccgaatagttgttttcttctcctgaaggaaactggaaagacggagcaatctgtcacttggggatgggcctgcggcgcattagctagttggtggggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaggtgacggtacctgagaagaaagccccggctaactacgtgccagcagccgcggtaatacgtagggggcaagcgttgtccggaattattgggcgtaaagcgcgcgcaggcggtcatttaagtctggtgtttaatcccggggctcaaccccggatcgcactggaaactgggtgacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgagtgctaggtgttaggggtttcgatacccttggtgccgaagttaacacattaagcactccgcctggggagtacggtcgcaagactgaaactcaaaggaattgacggggacccgcacaagcagtgggagtatgtggtttaattcgaagcaacgcgaagaaccttaccaggtcttgacatccctctgaccggtacagagatgtacctttccttcgggacagaggagacaggtggtgcatggttgtcgtcagctcgtgtcgtgagatgttgggttaagtcccgcaacgagcgcaacccttgatcttagttgccagcacttcgggtgggcactctaaggtgactgccggtgacaaaccggaggaaggtggggatgacgtcaaatcatcatgccccttatgacctgggctacacacgtactacaatggccggtacaacgggctgtgaagccgcgaggtggaacgaatcctaaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaaccgcaaggagccagccgccgatgt

SEQ ID NO: 908 - DNA, 1429 bp, Ochrobactrum sp.
atactgcagtcgagcggacttgatgagaagcttgcttctctgataggttagcggcggacgggtgagtaacacgtaggcaacctgccctcaagtttgggacaactaccggaaacggtagctaataccgaatagttgttttcttctcctgaaggaaactggaaagacggagcaatctgtcacttggggatgggcctgcggcgcattagctagttggtggggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaggtgacggtacctgagaagaaagccccggctaactacgtgccagcagccgcggtaatacgtagggggcaagcgttgtccggaattattgggcgtaaagcgcgcgcaggcggtcatttaagtctggtgtttaatcccggggctcaaccccggatcgcactggaaactgggtgacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgagtgctaggtgttaggggtttcgatacccttggtgccgaagttaacacattaagcactccgcctggggagtacggtcgcaagactgatactcaaaggaattgacggggacccgcacaagcagtggagtatgtggtttaattcgaagcaacgcgaagaaccttaccaggtcttgacatccctctgaccggtacagagatgtacctttccttcgggacagaggagacaggtggtgcatggttgtcgtcagctcgtgtcgtgagatgttgggttaagtcccgcaacgagcgcaacccttgatcttagttgccagcacttcgggtgggcactctaaggtgactgccggtgacaaaccggaggaaggtggggatgacgtcaaatcatcatgccccttatgacctgggctacacacgtactacaatggccggtacaacgggctgtgaagccgcgaggtggaacgaatcctaaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaaccgcaaggagccagccgccgaag

SEQ ID NO: 909 - DNA, 1421 bp, Ochrobactrum sp.
atgcagtcgagcgaatcgatgggagcttgctccctgagattagcggcggacgggtgagtaacacgtgggcaacctgcctataagactgggataacttcgggaaaccggagctaataccggatacgttcttttctcgcatgagagaagatggaaagacggtttacgctgtcacttatagatgggcccgcggcgcattagctagttggtgaggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgaagaaggccttcgggtcgtaaagttctgttgttagggaagaacaagtaccagagtaactgctggtaccttgacggtacctaaccagaaagccacggctaactacgtgccagcagccgcggtaatacgtaggtggcaagcgttgtccggaattattgggcgtaaagcgcgcgcaggtggttccttaagtctgatgtgaaagcccacggctcaaccgtggagggtcattggaaactggggaacttgagtgcagaagaggaaagtggaattccaagtgtagcggtgaaatgcgtagagatttggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaaccctagagatagggctttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaaacctgcgaaggtaagcgaatcccataaagccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtgaggtaaccttcatggagccagccgcct

SEQ ID NO: 910 - DNA, 1433 bp, Rhodococcus sp.
tatacatgcagtcgagcggacttgcatgagaagcttgcttctcatgataggttagcggcggacgggtgagtaacacgtaggcaacctgccctcaagtttgggacaactaccggaaacggtagctaataccgaatagttgttttcttctcctgaagaaaactggaaagacggagcaatctgtcacttggggatgggcctgcggcgcattagctagttggtggggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaggtgacggtacctgagaagaaagccccggctaactacgtgccagcagccgcggtaatacgtagggggcaagcgttgtccggaattattgggcgtaaagcgcgcgcaggcggtcatttaagtctggtgtttaatcccggggctcaaccccggatcgcactggaaactgggtgacttgagtgcagaagaggagagtggaattccacgtgtagcggtgaaatgcgtagatatgtggaggaacacccagtggcgaaggcgactctctgggctgtaactgacgctgaggcgcgaaagcgtggggagcaaacaggattagataccctggtagtccacgccgtaaacgatgagtgctaggtgttaggggtttcgatacccttggtgccgaagttaacacattaagcactccgcctggggagtacggtcgcaagactgaaactcaaaggaattgacggggacccgcacaagcagtgggagtatgtggtttaattcgaagcaacgcgaagaaccttaccaggtcttgacatccctctgaccggtacagagatgtacctttccttcgggacagaggagacaggtggtgcatggttgtcgtcagctcgtgtcgtgagatgttgggttaagtcccgcaacgagcgcaacccttgatcttagttgccagcacttcgggtgggcactctaaggtgactgccggtgacaaaccggaggaaggtggggatgacgtcaaatcatcatgccccttatgacctgggctacacacgtactacaatggccggtacaacgggctgtgaagccgcgaggtggaacgaatcctaaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaaccgcaaggagccagccgccga

SEQ ID NO: 911 - DNA, 1413 bp, Rhodococcus sp.
atgcatgagaagcttgcttctcatgataggttagcggcggacgggtgagtaacacgtaggcaacctgccctcaagtttgggacaactaccggaaacggtagctaataccgaatagttgttttcttctcctgaaggaaactggaaagacggagcaatctgtcacttggggatgggcctgcggcgcattagctagttggtggggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaggtgacggtacctgagaagaaagccccggctaactacgtgccagcagccgcggtaatacgtagggggcaagcgttgtccggaattattgggcgtaaagcgcgcgcaggcggtcatttaagtctggtgtttaatcccggggctcaaccccggatcgcactggaaactgggtgacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgagtgctaggtgttaggggtttcgatacccttggtgccgaagttaacacattaagcactccgcctggggagtacggtcgcaagactgaaactcaaaggaattgacggggacccgcacaagcagtggagtatgtggtttaattcgaagcaacgcgaagaaccttaccaggtcttgacatccctctgaccggtacagagatgtacctttccttcgggacagaggagacaggtggtgcatggttgtcgtcagctcgtgtcgtgagatgttgggttaagtcccgcaacgagcgcaacccttgatcttagttgccagcacttcgggtgggcactctaaggtgactgccggtgacaaaccggaggaaggtggggatgacgtcaaatcatcatgccccttatgacctgggctacacacgtactacaatggccggtacaacgggctgtgaagccgcgaggtggaacgaatcctaaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaaccgcaaggagccagccgccgaaat

SEQ ID NO: 912 - DNA, 1437 bp, Rhodococcus sp.
tatacatgcagtcgagcggactatgcatgagaagcttgcttctcatgataggttagcggcggacgggtgagtaacacgtaggcaacctgccctcaagtttgggacaactaccggaaacggtagctaataccgaatagttgttttcttctcctgaagaaaactggaaagacggagcaatctgtcacttggggatgggcctgcggcgcattagctagttggtggggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaggtgacggtacctgagaagaaagccccggctaactacgtgccagcagccgcggtaatacgtagggggcaagcgttgtccggaattattgggcgtaaagcgcgcgcaggcggtcatttaagtctggtgtttaatcccggggctcaaccccggatcgcactggaaactgggtgacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgagtgctaggtgttaggggtttcgatacccttggtgccgaagttaacacattaagcactccgcctggggagtacggtcgcaagactgaaactcaaaggaattgacggggacccgcacaagcagtggagtatgtggtttaattcgaagcaacgcgaagaaccttaccaggtcttgacatccctctgaccggtacagagatgtacctttccttcgggacagaggagacaggtggtgcatggttgtcgtcagctcgtgtcgtgagatgttgggttaagtcccgcaacgagcgcaacccttgatcttagttgccagcacttcgggtgggcactctaaggtgactgccggtgacaaaccggaggaaggtggggatgacgtcaaatcatcatgccccttatgacctgggctacacacgtactacaatggccggtacaacgggctgtgaagccgcgaggtggaacgaatcctaaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaaccgcaaggagccagccgccgaaggtg

SEQ ID NO: 913 - DNA, 1427 bp, Ochrobactrum sp.
tatacatgcaagtcgagcgaatcgatgggagcttgctccctgagattagcggcggacgggtgagtaacacgtgggcaacctgcctataagactgggataacttcgggaaaccggagctaataccggatacgttcttttctcgcatgagagaagatggaaagacggtttacgctgtcacttatagatgggcccgcggcgcattagctagttggtgaggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgaagaaggccttcgggtcgtaaagttctgttgttagggaagaacaagtaccagagtaactgctggtaccttgacggtacctaaccagaaagccacggctaactacgtgccagcagccgcggtaatacgtaggtggcaagcgttgtccggaattattgggcgtaaagcgcgcgcaggtggttccttaagtctgatgtgaaagcccacggctcaaacccgtggagggtcattggaaactggggaacttgagtgcagaagaggaaagtggaattccaagtgtagcggtgaaatgcgtagagatttggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaaccctagagatagggctttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaaacctgcgaaggtaagcgaatcccataaagccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtgaggtaaccttcatggagccagccgc

SEQ ID NO: 914 - DNA, 1430 bp, Enterobacteriaceae
acatgcagtcgagcggacttgatgagaagcttgcttctctgatggttagcggcggacgggtgagtaacacgtaggcaacctgccctcaagcttgggacaactaccggaaacggtagctaataccgaatagttgttttcttctcctgaagaaaactggaaagacggagcaatctgtcacttggggatgggcctgcggcgcattagctagttggtggggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaggtgacggtacctgagaagaaagccccggctaactacgtgccagcagccgcggtaatacgtagggggcaagcgttgtccggaattattgggcgtaaagcgcgcgcaggcggtcatttaagtctggtgtttaatcccggggctcaaccccggatcgcactggaaactgggtgacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgagtgctaggtgttaggggtttcgatacccttggtgccgaagttaacacattaagcactccgcctggggagtacggtcgcaagactgaaactcaaaggaattgacggggacccgcacaagcagtggagtatgtggtttaattcgaagcaacgcgaagaaccttaccaggtcttgacatccctctgaccggtacagagatgtacctttccttcgggacagaggagacaggtggtgcatggttgtcgtcagctcgtgtcgtgagatgttgggttaagtcccgcaacgagcgcaacccttgatcttagttgccagcacttcgggtgggcactctaaggtgactgccggtgacaaaccggaggaaggtggggatgacgtcaaatcatcatgccccttatgacctgggctacacacgtactacaatggccggtacaacgggctgtgaagccgcgaggtggaacgaatcctaaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaaccgcaaggagccagccgccgaaggtg

SEQ ID NO: 915 - DNA, 1422 bp, Paenibacillus sp.
cacatgcagtcggacggtagcacagaggagcttgctcctcgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaacggcccacctaggcgacgatccctagctggtctgagaggatgaccagccacactggaactgagacacggtccagactcctacgggaggcagcagtggggaatattgcacaatgggcgcaagcctgatgcacccatgccgcgtgtatgaagaaggccttcgggttgtaaagtactttcagcggggaggaaggcagtgaggttaataaccttactgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaaccctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttt

SEQ ID NO: 916 - DNA, 1416 bp, Paenibacillus sp.
acatgcagtcggacggtagcacagagaagcttgctcctcgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaacggcccacctaggcgacgatccctagctggtctgagaggatgaccagccacactggaactgagacacggtccagactcctacgggaggcagcagtggggaatattgcacaatgggcgcaagcctgatgcacccatgccgcgtgtatgaagaaggccttcgggttgtaaagtactttcagcggggaggaaggcagtgaggttaataaccttactgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtagttagcttaaccttcgggagggcgctaccacg

SEQ ID NO: 917 - DNA, 1379 bp, Paenibacillus sp.
acatgcagtcgaacgatgatcaggagcttgctcctgtgattagtggcgaacgggtgagtaacacgtgagtaacctgcccctgactctgggataagcgttggaaacgacgtctaatactggatacgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttg

SEQ ID NO: 918 - DNA, 1381 bp, Paenibacillus sp.
ccatgcagtcgaacgatgatcaggagcttgctcctgtgattagtggcgaacgggtgagtaacacgtgagtaacctgcccctgactctgggataagcgttggaaacgacgtctaatactggatacgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggtaacggccagagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtg

SEQ ID NO: 919 - DNA, 1422 bp, Paenibacillus sp.
cacatgcagtcgaacggcagcacaggagagcttgctctctgggtggcgagtggcggacgggtgaggaatacatcggaatctaccttttcgtgggggataacgtagggaaacttacgctaataccgcatacgaccttagggtgaaagcggaggaccttcgggcttcgcgcggatagatgagccgatgtcggattagctagttggcggggtaaaggcccaccaaggcgacgatccgtagctggtctgagaggatgatcagccacactggaactgagacacggtccagactcctacgggaggcagcagtggggaatattggacaatgggcgcaagcctgatccagccatgccgcgtgggtgaagaaggccttcgggttgtaaagcccttttgttgggaaagaaaagcagtcggttaatacccgattgttctgacggtacccaaagaataagcaccggctaacttcgtgccagcagccgcggtaatacgaagggtgcaagcgttactcggaattactgggcgtaaagcgtgcgtaggtggttgtttaagtccgttgtgaaagccctgggctcaaccctgggaattgcagtggatactgggcaactagagtgtggtagaggatggcggaattcccggtgtagcagtgaaatgcgtagagatcgggaggaacatctgtggcgaaggcggccatctggaccaacactgacactgaggcacgaaagcgtggggagcaaacaggattagataccctggtagtccacgccctaaacgatgcgaactggatgttgggtgcaacttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggtcttgacatccacggaactttccagagatggattggtgccttcgggaaccgtgagacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacgaccagggctacacacgtactacaatggtagggacagagggctgcaagccggcgacggtaagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgctgccacgg

SEQ ID NO: 920 - DNA, 1381 bp, Bacillus sp.
accatgcagtcgaacgatgatcaggagcttgctcctgtgattagtggcgaacgggtgagtaacacgtgagtaacctgcccctgactctgggataagcgttggaaacgacgtctaatactggatacgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtcccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttg

SEQ ID NO: 921 - DNA, 1394 bp, Paenibacillus sp.
taccatgcagtcgaacgatgatcaggagcttgctcctgtgattagtggcgaacgggtgagtaacacgtgagtaacctgcccctgactctgggataagcgttggaaacgacgtctaatactggatacgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacgggccagagatggttgccccctttgtggtccggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagc

SEQ ID NO: 922 - DNA, 1424 bp, Paenibacillus sp.
cacatgcaagtcgaacggcagcacaggagagcttgctctctgggtggcgagtggcggacgggtgaggaatacatcggaatctaccttttcgtgggggataacgtagggaaacttacgctaataccgcatacgaccttagggtgaaagcggaggaccttcgggcttcgcgcggatagatgagccgatgtcggattagctagttggcggggtaaaggcccaccaaggcgacgatccgtagctggtctgagaggatgatcagccacactggaactgagacacggtccagactcctacgggaggcagcagtggggaatattggacaatgggcgcaagcctgatccagccatgccgcgtgggtgaagaaggccttcgggttgtaaagcccttttgttgggaaagaaaagcagtcggttaatacccgattgttctgacggtacccaaagaataagcaccggctaacttcgtgccagcagccgcggtaatacgaagggtgcaagcgttactcggaattactgggcgtaaagcgtgcgtaggtggttgtttaagtccgttgtgaaagcccctgggctcaacctgggaattgcagtggatactgggcaactagagtgtggtagaggatggcggaattcccggtgtagcagtgaaatgcgtagagatcgggaggaacatctgtggcgaaggcggccatctggaccaacactgacactgaggcacgaaagcgtggggagcaaacaggattagataccctggtagtccacgccctaaacgatgcgaactggatgttgggtgcaacttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggtcttgacatccacggaactttccagagatggattggtgccttcgggaaccgtgagacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacgaccagggctacacacgtactacaatggtagggacagagggctgcaagccggcgacggtaagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgctgccacggt

SEQ ID NO: 923 - DNA, 1423 bp, Paenibacillus sp.
acacatgcagtcgaacggcagcacaggagagcttgctctctgggtggcgagtggcggacgggtgaggaatacatcggaatctaccttttcgtgggggataacgtagggaaacttacgctaataccgcatacgaccttagggtgaaagcggaggaccttcgggcttcgcgcggatagatgagccgatgtcggattagctagttggcggggtaaaggcccaccaaggcgacgatccgtagctggtctgagaggatgatcagccacactggaactgagacacggtccagactcctacgggaggcagcagtggggaatattggacaatgggcgcaagcctgatccagccatgccgcgtgggtgaagaaggccttcgggttgtaaagcccttttgttgggaaagaaaagcagtcggttaatacccgattgttctgacggtacccaaagaataagcaccggctaacttcgtgccagcagccgcggtaatacgaaagggtgcaagcgttactcggaattactgggcgtaaagcgtgcgtaggtggttgtttaagtccgttgtgaaagccctgggcttaacctgggaattgcagtggatactgggcaactagagtgtggtagaggatggcggaattcccggtgtagcagtgaaatgcgtagagatcgggaggaacatctgtggcgaaggcggccatctggaccaacactgacactgaggcacgaaaagcgtggggagcaaacaggattagataccctggtagtccacgccctaaacgatgcgaactggatgttgggtgcaacttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaagcttacctggtcttgacatccacggaactttccagagatggattggtgccttcgggaaccgtgagacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacgaccagggctacacacgtactacaatggtagggacagagggctgcaagccggcgacggtaagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgctgccacg

SEQ ID NO: 924 - DNA, 1381 bp, Bacillus sp.
gcatgcagtcgacgatgatcaggagcttgctcctgtgattagtggcgaacgggtgagtaacacgtgagtaacctgcccctgactctgggataagcgttggaaacgacgtctaatactggatacgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtgg

SEQ ID NO: 925 - DNA, 1374 bp, Paenibacillus sp.
gcagtcgaacgatgatcaggagcttgctcctgtgattagtggcgaacgggtgagtaacacgtgagtaacctgcccctgactctgggataagcgttggaaacgacgtctaatactggatacgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaaccctt

SEQ ID NO: 926 - DNA, 1415 bp, Enterobacteriaceae
ccatgcaagtcggacggtagcacagaggagcttgctcctcgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaacggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcagtgaggttaataaccttactgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacacacatgggagtgggttgcaaaagaagtaggtagcttaaccttcgggagggcgcttac

SEQ ID NO: 927 - DNA, 1415 bp, Enterobacteriaceae
cacatgcagtcggacggtagcacagaggagcttgctcctcgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaacggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcagtgaggttaataaccttactgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggtattcggcagagatgccttagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgctacca

SEQ ID NO: 928 - DNA, 1412 bp, Curtobacterium sp.
catgcagtcgaacggcagcacaggagagcttgctctctgggtggcgagtggcggacgggtgaggaatacatcggaatctaccttttcgtgggggataacgtagggaaacttacgctaataccgcatacgaccttagggtgaaagcggaggaccttcgggcttcgcgcggatagatgagccgatgtcggattagctagttggcggggtaaaggcccaccaaggcgacgatccgtagctggtctgagaggatgatcagccacactggaactgagacacggtccagactcctacgggaggcagcagtggggaatattggacaatgggcgcaagcctgatccagccatgccgcgtgggtgaagaaggccttcgggttgtaaagcccttttgttgggaaagaaaagcagtcggttaatacccgattgttctgacggtacccaaagaataagcaccggctaacttcgtgccagcagccgcggtaatacgaagggtgcaagcgttactcggaattactgggcgtaaagcgtgcgtaggtggttgtttaagtccgttgtgaaagccctgggctcaacctgggaattgcagtggatactgggcaactagagtgtggtagaggatggcggaattcccggtgtagcagtgaaatgcgtagagatcgggaggaacatctgtggcgaaggcggccatctggaccaacactgacactgaggcacgaaagcgtggggagcaaacaggattagataccctggtagtccacgccctaaacgatgcgaactggatgttgggtgcaacttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggtcttgacatccacggaactttccagagatggattggtgccttcgggaaccgtgagacaggtgctgcatggctgtcgtcagctcgtgtcgtgagatgttgggttaagtcccgcaacgagcgcaacccttgtccttagttgccagcacgtaatggtgggaactttaaggagaccgccggtgacaaaccggaggaaggtggggatgacgtcaagtcatcatggcccttacgaccagggctacacacgtactacaatggtagggacagagggctgcaagccggcgacggtaagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgct

SEQ ID NO: 929 - DNA, 1406 bp, Curtobacterium sp.
cacatgcaagtcgagcggatgagaggagcttgctcctcgattcagcggcggacgggtgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccttcgggtcgtaaagcactttaagttgggaggaagggctcatagcgaatacctgtgagttttgacgttaccaacagaataagcaccggctaacttcgtgccagcagccgcggtaatacgaagggtgcaagcgttaatcggaattactgggcgtaaagcgcgcgtaggtggcttgataagttggatgtgaaatccccgggctcaaccctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccctcgggaggacg

SEQ ID NO: 930 - DNA, 1423 bp, Xanthomonas sp.
aacacatgcaagtcgaacggcagcaacagcagagcttgctctgtgggtggcgagtggcggacgggtgagtaatgcatcgggacctacccagacgtgggggataacgtagggaaacttacgctaataccgcatacgtcctacgggagaaagcgggggatcgcaagacctcgcgcggttggatggaccgatgtgcgattagctagttggtgaggtaatggctcaccaaggcgacgatcgctagctggtctgagaggatgatcagccacactgggactgagacacggcccagactcctacgggaggcagcagtggggaatattggacaatgggcgcaagcctgatccagcaatgccgcgtgtgtgaagaaggccctcgggttgtaaagcacttttatcaggagcgaaatctgcaaggttaatacctttgcagtctgacggtacctgaggaataagcaccggctaactccgtgccagcagccgcggtaatacggagggtgcaagcgttaatcggaattactgggcgtaaagcgtgcgtaggcggttcgttaagtctgctgtgaaagccccgggctcaacctgggaatggcagtggatactggcgagctagagtgtgatagaggatggtggaattcccggtgtagcggtgaaatgcgtagagatcgggaggaacatcagtggcgaaggcggccatctggatcaacactgacgctgaggcacgaaagcgtggggagcaaacaggattagataccctggtagtccacgccctaaacgatgcgaactggatgttggtctcaactcggagatcagtgtcgaagctaacgcgttaagttcgccgcctggggagtacggtcgcaagactgaaactcaaaggaattgacgggggcccgcacaagcggtggagtatgtggtttaattcgatgcaacgcgaagaaccttacctgggccttgacatgtccggaatcctgcagagatgcgggagtgccttcgggaatcggaacacaggtgctgcatggctgtcgtcagctcgtgtcgtgagatgttgggttaagtcccgcaacgagcgcaacccttgtccttagttgccagcgagtaatgtcgggaactctaaggagactgccggtgacaaaccggaggaaggtggggatgacgtcaagtcatcatggcccttacggccagggctacacacgtactacaatggtcggtacagagggttgcgataccgcgaggtggagctaatcccagaaagccgatcccagtccggattggagtctgcaactcgactccatgaagtcggaatcgctagtaatcgcagatcagctatgctgcggtgaatacgttcccgggccttgtacacaccgcccgtcacaccatgggagtgagctgctccagaagccgttagtctaaccgcaagggggacgacgacc

SEQ ID NO: 931 - DNA, 1405 bp, Curtobacterium sp.
tgcaagtcgagcggatgagaggagcttgctcttcgattcagcggcggacgggtgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccctcgggtcgtaaagcactttaagttgggaggaagggctcatagcgaatacctgtgagttttgacgttaccaacagaataagcaccggctaacttcgtgccagcagccgcggtaatacgaagggtgcaagcgttaatcggaattactgggcgtaaagcgcgcgtaggtggcttgataagttggatgtgaaatccccgggctcaacctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccttcgggaggacggtac

SEQ ID NO: 932 - DNA, 1411 bp, Curtobacterium sp.
caagtcggacggtagcacagaggagcttgctcctcgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaacggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcagtgaggttaataaccttactgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaagcttacctactcttgacatccacggaattcgggcagagatgccttagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacacgcatgggagtgggttgcaaaagaagtaggtagcttaacctccgggagggcgcttac

SEQ ID NO: 933 - DNA, 1368 bp, Xanthomonas sp.
acacatgcagtcgaacgaaggcttcggccttagtggcgcacgggtgcgtaacgcgtgggaatctgccctttggttcggaataacagctggaaacggctgctaataccggatgatgacgaaagtccaaagatttatcgccagaggatgagcccgcgttggattaggtagttggtggggtaaaggcctaccaagccgacgatccatagctggtctgagaggatgatcagccacactgggactgagacacggcccagactcctacgggaggcagcagtggggaatattggacaatgggcgaaagcctgatccagcaatgccgcgtgagtgatgaaggccctagggttgtaaagctcttttacccgggaagataatgactgtaccgggagaataagccccggctaactccgtgccagcagccgcggtaatacggagggggctagcgttgttcggaattactgggcgtaaagcgcacgtaggcggctttgtaagtcagaggtgaaagcctggagctcaactccagaactgcctttgagactgcatcgcttgaatccaggagaggtcagtggaattccgagtgtagaggtgaaattcgtagatattcggaagaacaccagtggcgaaggcggctgactggactggtattgacgctgaggtgcgaaagcgtggggagcaaacaggattagataccctggtagtccacgccgtaaacgatgataactagctgtccgggcacttggtgcttgggtggcgcagctaacgcattaagttatccgcctggggagtacggccgcaaggttaaaactcaaaggaattgacgggggcctgcacaagcggtggagcatgtggtttaattcgaagcaacgcgcagaaccttaccagcgtttgacatgtccggacgatttccagagatggatctcttcccttcggggactggtacacaggtgctgcatggctgtcgtcagctcgtgtcgtgagatgttgggttaagtcccgcaacgagcgcaaccctcgcctttagttaccatcatttggttgggtactctaaaggaaccgccggtgataagccggaggaaggtggggatgacgtcaagtcctcatggcccttacgcgctgggctacacacgtgctacaatggcaactacagtgggcagcgaccctgcgagggcgagctaatccccaaaagttgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgttgcgccaacccgcaagggaagcaggcgaccacggtgt

SEQ ID NO: 934 - DNA, 1417 bp, Xanthomonas sp.
catgcaagtcggacggtagcacagaggagcttgctcctcgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaacggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcagtgaggttaataaccttactgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaacctccgggagggcgctaccatc

SEQ ID NO: 935 - DNA, 1363 bp, Curtobacterium sp.
acatgcagtcgaacgaaggcttcggccttagtggcgcacgggtgcgtaacgcgtgggaatctgccctttggttcggaataacagctggaaacggctgctaataccggatgatgacgaaagtccaaagatttatcgccagaggatgagcccgcgttggattaggtagttggtggggtaaaggcctaccaagccgacgatccatagctggtctgagaggatgatcagccacactgggactgagacacggcccagactcctacgggaggcagcagtggggaatattggacaatgggcgaaagcctgatccagcaatgccgcgtgagtgatgaaggccctagggttgtaaagctcttttacccgggaagataatgactgtaccgggagaataagccccggctaactccgtgccagcagccgcggtaatacggagggggctagcgttgttcggaattactgggcgtaaagcgcacgtaggcggctttgtaagtcagaggtgaaagcctggagctcaactccagaactgcctttgagactgcatcgcttgaatccaggagaggtcagtggaattccgagtgtagaggtgaaattcgtagatattcggaagaacaccagtggcgaaggcggctgactggactggtattgacgctgaggtgcgaaagcgtggggagcaaacaggattagataccctggtagtccacgccgtaaacgatgataactagctgtccgggcacttggtgcttgggtggcgcagctaacgcattaagttatccgcctggggagtacggccgcaaggttaaaactcaaaggaattgacgggggcctgcacaagcggtggagcatgtggtttaattcgaagcaacgcgcagaaccttaccagcgtttgacatgtccggacgatttccagagatggatctcttcccttcggggactggtacacaggtgctgcatggctgtcgtcagctcgtgtcgtgagatgttgggataagtcccgcaacgagcgcaaccctcgcctttagttaccatcatttggttgggtactctaaaggaaccgccggtgataagccggaggaaggtggggatgacgtcaagtcctcatggcccttacgcgctgggctacacacgtgctacaatggcaactacagtgggcagcgaccctgcgagggcgagctaatccccaaaagttgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgttgcgccaacccgcaagggaagcaggcgaccacag

SEQ ID NO: 936 - DNA, 1416 bp, Curtobacterium sp.
acatgcaagtcgagcggatgagaggagcttgctcttcgattcagcggcggacgggtgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccctcgggtcgtaaagcactttaagttgggaggaagggctcatagcgaatacctgtgagttttgacgttaccaacagaataagcaccggctaacttcgtgccagcagccgcggtaatacgaagggtgcaagcgttaatcggaattactgggcgtaaagcgcgcgtaggtggcttgataagttggatgtgaaatccccgggctcaacctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcatatgaattgacgggggcccgcacaagcggtggagcatgtggtttaattcgaagcaacgcgaagaaccttacctgggccttgacatgctgagaactttccagagatggattgggtgccttcgggaactcagacacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccttcgggaggacggtaccacgga

SEQ ID NO: 937 - DNA, 1403 bp, Enterobacteriaceae
gcaagtcgagcggatgagaggggcttgctcttcgattcagcggcggacgggtgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccctcgggtcgtaaagcactttaagttgggaggaagggctcatagcgaatacctgtgagttttgacgttaccaacagaataagcaccggctaacttcgtgccagcagccgcggtaatacgaagggtgcaagcgttaatcggaattactgggcgtaaagcgcgcgtaggtggcttgataagttggatgtgaaatccccgggctcaacctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccttcgggaggacggtt

SEQ ID NO: 938 - DNA, 1393 bp, Enterobacteriaceae
agtcgaacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaagggcttgacatacaccggaaacgggcagagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagccgtcgaat

SEQ ID NO: 939 - DNA, 1412 bp, Xanthomonas sp.
caagtcggacggtagcacagaggagcttgctcctcgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaacggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcagtgaggttaataaccttactgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaagggttaaaactcaaatgaattgacgggggcccgcacaagcggtggagcatgtggtttaattcgatgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaacctccgggagggcgctaccat

SEQ ID NO: 940 - DNA, 1392 bp, Pseudomonas sp.
acatgcagtcgaacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaagcttaccaaggcttgacatacaccggaaacggccagagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagccgt

SEQ ID NO: 941 - DNA, 1394 bp, Luteibacter sp.
catgcagtcgaacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaagcaccggctaactacgtgccagcagccgcggtaatacgtagggtgcaagcgttgtccgggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacgggctcagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagccgtcg

SEQ ID NO: 942 - DNA, 1402 bp, Pseudomonas sp.
tacacatgcaagtcgaacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacgggccagagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagccgtcgaat

SEQ ID NO: 943 - DNA, 1393 bp, Enterobacteriaceae
cacatgcaagtcgaacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagccg

SEQ ID NO: 944 - DNA, 1389 bp, Sphingomonas sp.
cacatgcagtcgaacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcgggggagcatgcggattaattcgatgcaacgcgaagaaccttaccaaggcttgacatacaccggaaacggccagagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggag

SEQ ID NO: 945 - DNA, 1368 bp, Enterobacteriaceae
tacacatgcaagtcgaacgaaggcttcggccttagtggcgcacgggtgcgtaacgcgtgggaatctgccctttggttcggaataacagctggaaacggctgctaataccggatgatgacgaaagtccaaagatttatcgccagaggatgagcccgcgttggattaggtagttggtggggtaaaggcctaccaagccgacgatccatagctggtctgagaggatgatcagccacactgggactgagacacggcccagactcctacgggaggcagcagtggggaatattggacaatgggcgaaagcctgatccagcaatgccgcgtgagtgatgaaggccctagggttgtaaagctcttttacccgggaagataatgactgtaccgggagaataagccccggctaactccgtgccagcagccgcggtaatacggagggggctagcgttgttcggaattactgggcgtaaagcgcacgtaggcggctttgtaagtcagaggtgaaagcctggagctcaactccagaactgcctttgagactgcatcgcttgaatccaggagaggtcagtggaattccgagtgtagaggtgaaattcgtagatattcggaagaacaccagtggcgaaggcggctgactggactggtattgacgctgaggtgcgaaagcgtggggagcaaacaggattagataccctggtagtccacgccgtaaacgatgataactagctgtccgggcacttggtgcttgggtggcgcagctaacgcattaagttatccgcctggggagtacggccgcaaggttaaaactcaaaggaattgacgggggcctgcacaagcggtggagcatgtggtttaattcgaagcaacgcgcagaaccttaccagcgtttgacatgtccggacgatttccagagatggatctcttcccttcggggactggaaacacaggtgctgcatggctgtcgtcagctcgtgtcgtgagatgttgggttaagtcccgcaacgagcgcaaccctcgcctttagttaccatcatttggttgggtactctaaaggaaccgccggtgataagccggaggaaggtggggatgacgtcaagtcctcatggcccttacgcgctgggctacacacgtgctacaatggcaactacagtgggcagcgaccctgcgagggcgagctaatccccaaaagttgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgttgcgccaacccgcaagggaagcaggcgaccacgg

SEQ ID NO: 946 - DNA, 1400 bp, Sphingomonas sp.
taccatgcagtcgaacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacgggctgagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagccgtcgaagg

SEQ ID NO: 947 - DNA, 1405 bp, Pseudomonas sp.
gcagtcggacggtagcacagaggagctttgctcctcgggtgacgagtggcggcacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaacggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcaatgaggttaataaccttgctgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgactttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtctcaccatgggagtgggttgcaaaagaagtaggtagcttaaccttcgggaggg

SEQ ID NO: 948 - DNA, 1416 bp, Pseudomonas sp.
tgcaagtcgaacggcagcacaggagagcttgctctctgggtggcgagtggcggacgggtgaggaatacatcggaatctaccttttcgtgggggataacgtagggaaacttacgctaataccgcatacgaccttagggtgaaagcggaggaccttcgggcttcgcgcggatagatgagccgatgtcggattagctagttggcggggtaaaggcccaccaaggcgacgatccgtagctggtctgagaggatgatcagccacactggaactgagacacggtccagactcctacgggaggcagcagtggggaatattggacaatgggcgcaagcctgatccagccatgccgcgtgggtgaagaaggccttcgggttgtaaagcccttttgttgggaaagaaaagcagtcggttaatacccgattgttctgacggtacccaaagaataagcaccggctaacttcgtgccagcagccgcggtaatacgaagggtgcaagcgttactcggaattactgggcgtaaagcgtgcgtaggtggttgtttaagtccgttgtgaaagccctgggctcaacctgggaattgcagtggatactgggcaactagagtgtggtagaggatggcggaattcccggtgtagcagtgaaatgcgtagagatcgggaggaacatctgtggcgaaggcggccatctggaccaacactgacactgaggcacgaaagcgtggggagcaaacaggattagataccctggtagtccacgccctaaacgatgcgaactggatgttgggtgcaacttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggtcttgacatccacggaactttccagagatggtatggtgccttcgggaaccgtgagacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacgaccagggctacacacgtactacaatggtagggacagagggctgcaagccggcgacggtaagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgctgccac

SEQ ID NO: 949 - DNA, 1358 bp, Curtobacterium sp.
cacatgcagtcgaacgaaggcttcggccttagtggcgcacgggtgcgtaacgcgtgggaatctgccctttggttcggaataacagctggaaacggctgctaataccggatgatgacgaaagtccaaagatttatcgccagaggatgagcccgcgttggattaggtagttggtggggtaaaggcctaccaagccgacgatccatagctggtctgagaggatgatcagccacactgggactgagacacggcccagactcctacgggaggcagcagtggggaatattggacaatgggcgaaagcctgatccagcaatgccgcgtgagtgatgaaggccctagggttgtaaagctcttttacccgggaagataatgactgtaccgggagaataagccccggctaactccgtgccagcagccgcggtaatacggagggggctagcgttgttcggaattactgggcgtaaagcgcacgtaggcggctttgtaagtcagaggtgaaagcctggagctcaactccagaactgcctttgagactgcatcgcttgaatccaggagaggtcagtggaattccgagtgtagaggtgaaattcgtagatattcggaagaacaccagtggcgaaggcggctgactggactggtattgacgctgaggtgcgaaagcgtggggagcaaacaggattagataccctggtagtccacgccgtaaacgatgataactagctgtccgggcacttggtgcttgggtggcgcagctaacgcattaagttatccgcctggggagtacggccgcaaggttaaaactcaaaggaattgacgggggcctgcacaagcggtggagcatgtggtttaattcgaagcaacgcgcagaaccttaccagcgtttgacatgtccggacgatttccagagatggatctcttcccttcggggactggaacacaggtgctgcatggctgtcgtcagctcgtgtcgtgagatgttgggttaagtcccgcaacgagcgcaaccctcgcctttagttaccatcatttggttgggtactctaaaggaaccgccggtgataagccggaggaaggtggggatgacgtcaagtcctcatggcccttacgcgctgggctacacacgtgctacaatggcaactacagtgggcagcgaccctgcgagggcgagctaatccccaaaagttgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgttgcgccaacccgcaaggaagcaggcgac

SEQ ID NO: 950 - DNA, 1415 bp, Enterobacteriaceae
catgcaagtcggacggtagcacagaggagcttgctcctcgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaacggcccacctaggcgacgatccctagctggtctgagaggatgaccagccacactggaactgagacacggtccagactcctacgggaggcagcagtggggaatattgcacaatgggcgcaagcctgatgcacccatgccgcgtgtatgaagaaggccttcgggttgtaaagtactttcagcggggaggaaggcagtgaggttaataaccttactgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggatctaattccaggtgtagcggtgaaatgcgtagagatctggaggaataccggtggcgaaggcggccccctggacgaagactgacgctcacgtgcgaaagcgtggggagcaaacacgattacataccctggtagtccacgccgtatacgatgtcgacttggaggttgttcccttgacgagtgccttccggagctaacgcgttaagtcgaccgcctggcgagtacggccgcaaggttaaaactcaaatgaattgacgggggcccgcacaagcggtggagcatgtggtttaattcgatgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacagcacatgggagtgggttgcaaaagaagtaggtagcttaacctccgggagggcgctta

SEQ ID NO: 951 - DNA, 1374 bp, Curtobacterium sp.
agtcgaacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaaatcatgaaagtcggtaacacccgaagccggtggcctaacccttgt

SEQ ID NO: 952 - DNA, 1388 bp, Curtobacterium sp.
caagtcgaacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggatcgccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagccgt

SEQ ID NO: 953 - DNA, 1374 bp, Curtobacterium sp.
cagtcgaacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaacagtcggtaacacccgaagccggtggcctaaccctt

SEQ ID NO: 954 - DNA, 1386 bp, Curtobacterium sp.
acacatgcaagtcgaacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtgga

SEQ ID NO: 955 - DNA, 1393 bp, Curtobacterium sp.
tacacatgcaagtcgaacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaagagcc

SEQ ID NO: 956 - DNA, 1392 bp, Sphingomonas sp.
acacatgcaagtcgaacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagc

SEQ ID NO: 957 - DNA, 1401 bp, Curtobacterium sp.
tacacatgcaagtcgaacggtgaagccaagcttgcttggtggatcagtggcgaacgggtgagtaacacgtgagcaacctgccctggactctgggataagcgctggaaacggcgtctaatactggatatgagcctcttccgcatggtgggggttggaaagattttttggtctgggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcggaagcctgatgcagcaacgccgcgtgagggatgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatcccgaggctcaacctcgggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggaccattccacggtttccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatacaccagaacgggccagaaatggtcaactctttggacactggtgaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcccaacccttgtggagggagccgtcgaat

SEQ ID NO: 958 - DNA, 1367 bp, Enterobacteriaceae
acgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaaccctgt

SEQ ID NO: 959 - DNA, 1347 bp, Xanthomonas sp.
gcagtcgaacgaaggcttcggccttagtggcgcacgggtgcgtaacgcgtgggaatctgccctttggttcggaataacagctggaaacggctgctaataccggatgatgacgaaagtccaaagatttatcgccagaggatgagcccgcgttggattaggtagttggtggggtaaaggcctaccaagccgacgatccatagctggtctgagaggatgatcagccacactgggactgagacacggcccagactcctacgggaggcagcagtggggaatattggacaatgggcgaaagcctgatccagcaatgccgcgtgagtgatgaaggccctagggttgtaaagctcttttacccgggaagataatgactgtaccgggagaataagccccggctaactccgtgccagcagccgcggtaatacggagggggctagcgttgttcggaattactgggcgtaaagcgcacgtaggcggctttgtaagtcagaggtgaaagcctggagctcaactccagaactgcctttgagactgcatcgcttgaatccaggagaggtcagtggaattccgagtgtagaggtgaaattcgtagatattcggaagaacaccagtggcgaaggcggctgactggactggtattgacgctgaggtgcgaaagcgtggggagcaaacaggattagataccctggtagtccacgccgtaaacgatgataactagctgtccgggcacttggtgcttgggtggcgcagctaacgcattaagttatccgcctggggagtacggccgcaaggttaaaactcaaaggaattgacgggggcctgcacaagcggtggagcatgtggtttaattcgaagcaacgcgcagaaccttaccagcgtttgacatgtccggacgactggcagagatgcctttcttcccttcggggactggaacacaggtgctgcatggctgtcgtcagctcgtgtcgtgagatgttgggttaagtcccgcaacgagcgcaaccctcgcctttagttaccatcatttggttgggtactctaaaggaaccgccggtgataagccggaggaaggtggggatgacgtcaagtcctcatggcccttacgcgctgggctacacacgtgctacaatggcaactacagtgggcagcgaccctgcgagggcgagctaatccccaaaagttgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgttgcgccaacccgtaaggaagca

SEQ ID NO: 960 - DNA, 1384 bp, Sphingomonas sp.
cagtcgaacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaaccctgtggaagagccg

SEQ ID NO: 961 - DNA, 1364 bp, Enterobacteriaceae
acacatgcagtcgaacgaaggcttcggccttagtggcgcacgggtgcgtaacgcgtgggaatctgccctttggttcggaataacagctggaaacggctgctaataccggatgatgacgaaagtccaaagatttatcgccagaggatgagcccgcgttggattaggtagttggtggggtaaaggcctaccaagccgacgatccatagctggtctgagaggatgatcagccacactgggactgagacacggcccagactcctacgggaggcagcagtggggaatattggacaatgggcgaaagcctgatccagcaatgccgcgtgagtgatgaaggccctagggttgtaaagctcttttacccgggaagataatgactgtaccgggagaataagccccggctaactccgtgccagcagccgcggtaatacggagggggctagcgttgttcggaattactgggcgtaaagcgcacgtaggcggctttgtaagtcagaggtgaaagccctggagctcaactccagaactgcctttgagactgcatcgcttgaatcccaggagaggtcagtggaattccgagtgtagaggtgaaattcgtagatattcggaagaacaccagtggcgaaggcggctgactggactggtattgacgctgaggtgcgaaagcgtggggagcaaacaggattagataccctggtagtccacgccgtaaacgatgataactagctgtccgggcacttggtgcttgggtggcgcagctaacgcattaagttatccgcctggggagtacggccgcaaggttaaaactcaaaggaattgacgggggcctgcacaagcggtggagcatgtggtttaattcgaagcaacgcgcagaaccttaccagcgtttgacatgtccggacgactggcagagatgcctttcttcccttcggggactgggaaacacaggtgctgcatggctgtcgtcagctcgtgtcgtgagatgttgggttaagtcccgcaacgagcgcaaccctcgcctttagttaccatcatttggttgggtactctaaaggaaccgccggtgataagccggaggaaggtggggatgacgtcaagtcctcatggcccttacgcgctgggctacacacgtgctacaatggcaactacagtgggcagcgaccctgcgagggcgagctaatccccaaaagttgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgttgcgccaacccgtaaggaagcaggcgacc

SEQ ID NO: 962 - DNA, 1376 bp, Curtobacterium sp.
aagtcgaacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtg

SEQ ID NO: 963 - DNA, 1386 bp, Curtobacterium sp.
caagtcgaacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaaccctgtggaaggagccg

SEQ ID NO: 964 - DNA, 1396 bp, Curtobacterium sp.
gcagtcgagcggatgagaggagcttgctcctcgattcagcggcggacgggtgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccttcgggtcgtaaagcactttaagttgggaggaagggctcatagcgaatacctgtgagttttgacgttaccaacagaataagcaccggctaacttcgtgccagcagccgcggtaatacgaagggtgcaagcgttaatcggaattactgggcgtaaagcgcgcgtaggtggcttgataagttggatgtgaaatccccgggctcaacctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccttcgggagg

SEQ ID NO: 965 - DNA, 1395 bp, Curtobacterium sp.
atgcaagtcggacggtagcacagaggagcttgctcctcgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaacggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcaataaggttaataaccttgttgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtctatccatgggagtgggttgcaaaagaagtaggtagctaactc

SEQ ID NO: 966 - DNA, 1430 bp, Curtobacterium sp.
atacatgcaagtcgagcgaatggattaagagcttgctcttatgaagttagcggcggacgggtgagtaacacgtgggtaacctgcccataagactgggataactccgggaaaccggggctaataccggataacattttgaactgcatggttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaacccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgaaaaccctagagatagggcttctccttcgggagcagagtgacaggtggtgcatggttgtcgtcagctcgtgtcgtgagatgttgggttaagtcccgcaacgagcgcaacccttgatcttagttgccatcattaagttgggcactctaaggtgactgccggtgacaaaccggaggaaggtggggatgacgtcaaatcatcatgccccttatgacctgggctacacacgtgctacaatggacggtacaaagagctgcaagaccgcgaggtggagctaatctcataaaaccgttctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaaccttttggagccagccgcctatg

SEQ ID NO: 967 - DNA, 1416 bp, Curtobacterium sp.
acatgcagtcggacggtagcacagaggagcttgctcctcgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaacggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcaataaggttaataaccttgttgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaatactcaaatgaattgacgggggcccgcacaagcggtggagcatgtggtttaattcgatgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaacctccgggagggcgcttaccgt

SEQ ID NO: 968 - DNA, 1417 bp, Microbacterium sp.
acatgcaagtcggacggtagcacagaggagcttgctcctcgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaacggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcaataaggttaataaccttgttgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaacctccgggagggcgctaccata

SEQ ID NO: 969 - DNA, 1405 bp, Curtobacterium sp.
atgcagtcggacggtagcacagaggagcttgctcctcgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaacggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcaataaggttaataaccttgttgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattcccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaagctttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaacctccgggagg

SEQ ID NO: 970 - DNA, 1412 bp, Sphingomonas sp.
acatgcaagtcggacggtagcacagaggaagcttgctcctcgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaacggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcaataaggttaataaccttgttgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaacctccgggagggcgct

SEQ ID NO: 971 - DNA, 1337 bp, Curtobacterium sp.
cacatgcaagtcgagcgggcatccttgtggtgtcagcggcagacgggtgagtaacgcgtgggaacgtgcccttcggttcggaataactcagggaaacttgagctaataccggatacgtgcgagagcagaaaggtttactgccgaaggatcggcccgcgtctgattagctagttggtgaggttacggctcaccaaggcgacgatcagtagctggtctgagaggatgatcagccacactgggactgagacacggcccagactcctacgggaggcagcagtggggaatattggacaatgggggcaaccctgatccagccatgccgcgtgagtgatgacggccttagggttgtaaagctcttttctccgggacgataatgacggtaccggaggaataagccccggctaacttcgtgccagcagccgcggtaatacgaagggggctagcgttgctcggaatcactgggcgtaaagggcgcgtaggcggctgatttagtcgagggtgaaagcccgtggctcaaccacggaatggccttcgatactgattggctcgagaccggaagaggacagcggaactgcgagtgtagaggtgaaattcgtagatattcgcaagaacaccagtggcgaaggcggctgtctggtccggttctgacgctgaggcgcgaaagcgtggggagcaaacaggattagataccctggtagtccacgctgtaaacgatgaatgctagccgttggggtgcatgcacctcagtggcgccgctaacgctttaagcattccgcctggggagtacggtcgcaagattaaaactcaaaggaattgacgggggcccgcacaagcggtggagcatgtggtttaattcgaagcaacgcgcagaaccttaccatcccttgacatggcatgcgagccggagagatccggtgttcccttcggggacgtgcacacaggtgctgcatggctgtcgtcagctcgtgtcgtgagatgttgggttaagtcccgcaacgagcgcaacccacgtcctcagttgccatcatttggttgggcactctggggagactgccggtgataagccgcgaggaaggtgtggatgacgtcaagtcctcatggcccttacgggatgggctacacacgtgctacaatggcggtgacaatgggcagcgaaggggcgacctggagcgaatccccaaaagccgtctcagttcggattgcactctgcaactcgggtgcatgaaggcggaatcgctagtaatcgtggatcagcatgccacggtgaatacgttcccgggccttgtacacaccgcccgtcacaccatgggagttggtcttacccgacggcgctgcgc

SEQ ID NO: 972 - DNA, 1395 bp, Sphingomonas sp.
ccatgcaagtcgaacggtgaagccaagcttgcttggtggatcagtggcgaacgggtgagtaacacgtgagcaacctgccctggactctgggataagcgctggaaacggcgtctaatactggatatgagacgtgatcgcatggtcgtgtttggaaagatttttcggtctgggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatcccgaggctcaacctcgggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggaccattccacggtttccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttgggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcccaacccttgtggagggagccgtc

SEQ ID NO: 973 - DNA, 1405 bp, Curtobacterium sp.
gcaagtcggacggtagcacagaagagcttgctcttcgggtgacgagtggcggacgggtgagtaatgtctgggaaactgcccgatggagggggataactactggaaacggtagctaataccgcataacgtcttcggaccaaagtgggggaccttcgggcctcacgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataacctcatcgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggctgttcccctgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctgggccttgacatccacggaacttggcagagatgccttggtgccttcgggaaccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacggccagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtagatcagaatgctacggtgaatacgttcccgggccttgtacacaccgcccgtcacaccatgggagtgggttgcaaaagaagtaggtagcttaacctccgggagggc

SEQ ID NO: 974 - DNA, 1401 bp, Curtobacterium sp.
cacatgcaagtcgaacggtaacaggtcttcggatgctgacgagtggcgaacgggtgagtaatacatcggaacgtgcccaagagtgggggataacggagcgaaagctttgctaataccgcatacgatctacggatgaaagcaggggaccgcaaggccttgcgctcatggagcggccgatggcagattaggtagttggtgggataaaagcttaccaagccgacgatctgtagctggtctgagaggacgaccagccacactgggactgagacacggcccagactcctacgggaggcagcagtggggaattttggacaatgggcgcaagcctgatccagccatgccgcgtgcaggatgaaggccttcgggttgtaaactgcttttgtacggaacgaaaagcctctttctaataaagaggggtcatgacggtaccgtaagaataagcaccggctaactacgtgccagcagccgcggtaatacgtagggtgcgagcgttaatcggaattactgggcgtaaagcgtgcgcaggcggtaatgtaagacagatgtgaaatccccgggctcaacctgggaactgcatttgtgactgcattgctggagtgcggcagagggggatggaattccgcgtgtagcagtgaaatgcgtagatatgcggaggaacaccgatggcgaaggcaatcccctgggcctgcactgacgctcatgcacgaaagcgtggggagcaaacaggattagataccctggtagtccacgccctaaacgatgtcaactggttgttgggtcttcactgactcagtaacgaagctaacgcgtgaagttgaccgcctggggagtacggccgcaaggttgaaactcaaaggaattgacggggacccgcacaagcggtggatgatgtggtttaattcgatgcaacgcgaaaaaccttacccacctttgacatgtacggaatcctttagagatagaggagtgctcgaaagagaaccgtaacacaggtgctgcatggctgtcgtcagctcgtgtcgtgagatgttgggttaagtcccgcaacgagcgcaacccttgccattagttgctacgaaagggcactctaatgggactgccggtgacaaaccggaggaaggtggggatgacgtcaagtcctcatggcccttataggtggggctacacacgtcatacaatggctggtacagagggttgccaacccgcgagggggagctaatcccataaagccagtcgtagtccggatcgcagtctgcaactcgactgcgtgaagtcggaatcgctagtaatcgcggatcagaatgtcgcggtgaatacgttcccgggtcttgtacacaccgcccgtcacaccatgggagcgggttctgccagaagtaggtagcctaaccgtaaggagggcgctca

SEQ ID NO: 975 - DNA, 1410 bp, Pseudomonas sp.
tgcagtcggacggtagcacagaagagcttgctcttcgggtgacgagtggcggacgggtgagtaatgtctgggaaactgcccgatggagggggataactactggaaacggtagctaataccgcataacgtcttcggaccaaagtgggggaccttcgggcctcacgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataacctcatcgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggctgttcccctgaggagtggcttccggagctaacgcgttaagtcgaccgcctgggggagtacggccgcaaggttaaaactcaaatgaattgacgggggcccgcacaagcggtggagcatgtggtttaattcgatgcaacgcgaagaaccttacctggccttgacatccacggaacttggcagagatgccttggtgccttcgggaaccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacggccagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtagatcagaatgctacggtgaatacgttcccgggccttgtacacaccgcccgtcacaccgatgggagtgggttgcaaaagaagtaggtagcttaaccttcgggagggcgcct

SEQ ID NO: 976 - DNA, 1414 bp, Enterobacteriaceae
atgcagtcggacggtagcacagaggagcttgctcctcgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaacggcccacctaggcgacgatccctagctggtctgagaggatgaccagccacactggaactgagacacggtccagactcctacgggaggcagcagtggggaatattgcacaatgggcgcaagcctgatgcacccatgccgcgtgtatgaagaaggccttcgggttgtaaagtactttcagcggggaggaaggcagtgaggttaataaccttgctgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggacgaataccggtggcgaaggcggccccctggacgaagactgacgctcacgtgcgaaagcgtggggagcaaacacgattacataccctggtagtccacgccgtaaacgatgtcgacttggacgttgttcccttgacgagtggcttccggagctaacgcgttaagtcgaccgcctggcgagtacggccgcaaggttaaaactcaaatgaattgacgggggcccgcacaagcggtggagcatgtggtttaattcgatgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaacctccgggagggcgctaccata

SEQ ID NO: 977 - DNA, 1406 bp, Bacillus sp.
atgcagtcgagcggatgagaggagcttgctcctcgattcagcggcggacgggtgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccttcgggtcgtaaagcactttaagttgggaggaagggctcatagcgaatacctgtgagttttgacgttaccaacagaataagcaccggctaacttcgtgccagcagccgcggtaatacgaagggtgcaagcgttaatcggaattactgggcgtaaagcgcgcgtaggtggcttgataagttggatgtgaaatccccgggctcaacctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctgggcatgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccctcgggaggacggttac

SEQ ID NO: 978 - DNA, 1384 bp, Pantoea sp.
gaagaggagcttgctcctcgattcagcggcggacgggtgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccttcgggtcgtaaagcactttaagttgggaggaagggctcatagcgaatacctgtgagttttgacgttaccaacagaataagcaccggctaacttcgtgccagcagccgcggtaatacgaagggtgcaagcgttaatcggaattactgggcgtaaagcgcgcgtaggtggcttgataagttggatgtgaaatccccgggctcaacctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccctcgggagga

SEQ ID NO: 979 - DNA, 1406 bp, Enterobacteriaceae
atgcaagtcgagcggatgagaggagcttgctcctcgattcagcggcggacgggtgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccttcgggtcgtaaagcactttaagttgggaggaagggctcatagcgaatacctgtgagttttgacgttaccaacagaataagcaccggctaacttcgtgccagcagccgcggtaatacgaagggtgcaagcgttaatcggaattactgggcgtaaagcgcgcgtaggtggcttgataagttggatgtgaaatccccgggctcaacctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattgggtgccttcgggaactcagacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccctcgggaggacggta

SEQ ID NO: 980 - DNA, 1431 bp, Enterobacteriaceae
acatgcaagtcgagcggacttgcatgagaagcttgcttctcatgataggttagcggcggacgggtgagtaacacgtaggcaacctgccctcaagcttgggacaactaccggaaacggtagctaataccgaatagttgttttcttctcctgaagaaaactggaaagacggagcaatctgtcacttggggatgggcctgcggcgcattagctagttggtggggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaggtgacggtacctgagaagaaagccccggctaactacgtgccagcagccgcggtaatacgtagggggcaagcgttgtccggaattattgggcgtaaagcgcgcgcaggcggtcatttaagtctggtgtttaatcccggggctcaaccccggatcgcactggaaactgggtgacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgagtgctaggtgttaggggtttcgatacccttggtgccgaagttaacacattaagcactccgcctggggagtacggtcgcaagactgaaactcaaaggaattgacggggacccgcacaagcagtggagtatgtggtttaattcgaagcaacgcgaagaaccttaccaggtcttgacatccctctgaccggtacagagatgtacctttccttcgggacagaggagacaggtggtgcatggttgtcgtcagctcgtgtcgtgagatgttgggttaagtcccgcaacgagcgcaacccttgatcttagttgccagcacttcgggtgggcactctaaggtgactgccggtgacaaaccggaggaaggtggggatgacgtcaaatcatcatgccccttatgacctgggctacacacgtactacaatggccggtacaacgggctgtgaagccgcgaggtggaacgaatcctaaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaaccgcaaggagccagccgccgata

SEQ ID NO: 981 - DNA, 1426 bp, Enterobacteriaceae
tacatgcaagtcgagcgaacagacgaggagcttgctcctttgacgttagcggcggacgggtgagtaacacgtgggtaacctacctataagactgggataacttcgggaaaccggagctaataccggataatatttcgaaccgcatggttcgatagtgaaagatggctctgctatcacttatagatggacctgcgccgtattagctagttggtaaggtaacggcttaccaaggcaacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacaaacgtgtaagtaactgtgcacgtcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgacccttctagagatagaagtttccccttcgggggacaaagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatgacgtcaaatcatcatgccccttatgatttgggctacacatgtgctacaatggacaatacaaagggcagcgaaaccgcgaggtcaagcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccatttggagctagccgtcga

SEQ ID NO: 982 - DNA, 1389 bp, Enterobacteriaceae
agacgaggagcttgctcctttgacgttagcggcggacgggtgagtaacacgtgggtaacctacctataagactgggataacttctggaaaccggagctaataccggataatatttcgaaccgcatggttcgatagtgaaagatggctctgctatcacttatagatggacctgcgccgtattatctagttggtaaggtaacggcttaccaaggcaacgatacgtagccgacctgagagggtgatcggccacactggaactgagacacgggccagactcctacgggaggcagcagtagggaatcttccgcaatgggcgaaagcctgacggagcaacgccgcgtgagtgatgaaggtcttcggatcgtaaaactctgttattagggaagaacaaacgtgtaagtaactgtgcacgtcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgacccttctagagatagaagtttccccttcgggggacaaagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacaatacaaagggcagcgaaaccgcgaggtcaagcaaatcccataaagttgttctcagttcggattgtagtctgcaactcgactacatgaagctggaatcgctagtaatcgtagatcagcatgctacggtgaatacgttcccgggtcttgtacacaccgcccgtctctccggcgagagtttgtaacacccgaagccggtggagtaacca

SEQ ID NO: 983 - DNA, 499 bp, Microbacterium sp.
gaacggtgaacacggagcttgctctgtgggatcagtggcgaacgggtgagtaacacgtgagcaacctgcccctgactctgggataagcgctggaaacggcgtctaatactggatatgtgacgtgaccgcatggtctgcgtttggaaagatttttcggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggatgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgta

SEQ ID NO: 984 - DNA, 740 bp, Erwinia sp.
  modified_base (4)..(4): a, c, t or g
  modified_base (7)..(7): a, c, t or g
  modified_base (10)..(10): a, c, t or g
  modified_base (15)..(15): a, c, t or g
  modified_base (18)..(18): a, c, t or g
  modified_base (613)..(613): a, c, t or g
  modified_base (636)..(636): a, c, t or g
  modified_base (638)..(638): a, c, t or g
  modified_base (677)..(677): a, c, t or g
  modified_base (691)..(691): a, c, t or g
  modified_base (708)..(708): a, c, t or g
cganacnggnagccntanaacacatgcaagtcgaacgatgaactccagcttgctggggggattagtggcgaacgggtgagtaacacgtgagtaacctgcccttgactctgggataagcgctggaaacggcgtctaataccggatacgagcttcagccgcatggctaggagttggaaagaatttcggtcaaggatggactcgcggcctatcagctagttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatctgggggctcaacccccagcctgcagtgggtacgggcagactagagtgcggtaggggnagattggaattcctggtgtagcngngggaatgcgcagatatcaggaggaacaccgatggcgaangcagatctctgggnccgtaactgacgctgangagcgaaagcgtggggagcgaacaggattaga

SEQ ID NO: 985 - DNA, 560 bp, Acidovorax sp.
  modified_base (146)..(146): a, c, t or g
  modified_base (237)..(237): a, c, t or g
  modified_base (417)..(418): a, c, t or g
  modified_base (428)..(428): a, c, t or g
  modified_base (432)..(432): a, c, t or g
cgctggcggcatgctttacacatgcaagtcgaacggcagcgcggggcaacctggcggcgagtggcgaacgggtgagtaatatatcggaacgtacccaagagtgggggataacgtagcgaaagttacgctaataccgcatacgatcnaaggatgaaagcaggggatcttcggaccttgtgctcctggagcggccgatatctgattagctagttggtgaggtaaaggctcaccaaggcnacgatcagtagctggtctgagaggacgaccagccacactggaactgagacacggtccagactcctacgggaggcagcagtggggaattttggacaatgggcgaaagcctgatccagcaatgccgcgtgagtgaagaaggccttcgggttgtaaagctcttttgtcagggaagaaacggtnngggctaatancctnagctaatgacggtacctgaagaataagcaccggctaactacgtgccagcagccgcggtaatacgtagggtgcaagcgttaatcggaattactgggcgtaaagcgtgcgcaggcggttttgtaagtctg

SEQ ID NO: 986 - DNA, 740 bp, Erwinia sp.
  modified_base (2)..(2): a, c, t or g
  modified_base (113)..(113): a, c, t or g
  modified_base (172)..(172): a, c, t or g
  modified_base (626)..(626): a, c, t or g
  modified_base (685)..(685): a, c, t or g
  modified_base (692)..(693): a, c, t or g
  modified_base (695)..(695): a, c, t or g
  modified_base (702)..(702): a, c, t or g
  modified_base (708)..(708): a, c, t or g
  modified_base (729)..(729): a, c, t or g
cnacgctggcggctgcctaatacatgcaagtcgagcggacttgaagagaagcttgcttctccgatggttagcggcggacgggtgagtaacacgtaggcaacctgccctcaagnttgggacaactaccggaaacggtagctaataccgaatagttgttttcttctcctgaagnaaactggaaagacggagcaatctgtcacttggggatgggcctgcggcgcattagctagttggtggggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaggtgacggtacctgagaagaaagccccggctaactacgtgccagcagccgcggtaatacgtagggggcaagcgttgtccggaattattgggcgtaaagcgcgcgcaggcggtcatttaagtctggtgtttaatcccggggctcaaccccggatcgcactggaaactgggntgacttgagtgcagaagaggagagtggaattccacgtgtagcggtgaaatgcgtagaanttttggnngnacccccngtggcnaaaggcgactctctgggctgnaactgacgctg

SEQ ID NO: 987 - DNA, 509 bp, Enterobacteriaceae
gtcgaacgaaggcttcggccttagtggcgcacgggtgcgtaacgcgtgggaatctgccccttggttcggaataacagttggaaacgactgctaataccggatgatgacgtaagtccaaagatttatcgccgagggatgagcccgcgtaggattaggtagttggtgtggtaaaggcgcaccaagccgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggatgataatgacagtaccgggagaataagctccggctaactccgtgccagcagccgcggtaatacggagggagctagcgttattcggaattactgggcgtaaagcgcacgtaggcggctttgtaagtaagaggtgaaagcccagagctcaactct

SEQ ID NO: 988 - DNA, 740 bp, Pseudomonas sp.
  modified_base (2)..(2): a, c, t or g
  modified_base (4)..(5): a, c, t or g
  modified_base (10)..(11): a, c, t or g
  modified_base (683)..(683): a, c, t or g
cnannctggnngcctgcctaatacatgcaagtcgagcgaatcgatgggagcttgctccctgagattagcggcggacgggtgagtaacacgtgggcaacctgcctataagactgggataacttcgggaaaccggagctaataccggatacgttcttttctcgcatgagagaagatggaaagacggtttacgctgtcacttatagatgggcccgcggcgcattagctagttggtgaggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgaagaaggccttcgggtcgtaaagttctgttgttagggaagaacaagtaccagagtaactgctggtaccttgacggtacctaaccagaaagccacggctaactacgtgccagcagccgcggtaatacgtaggtggcaagcgttgtccggaattattgggcgtaaagcgcgcgcaggtggttccttaagtctgatgtgaaagcccacggctcaaccgtggagggtcattggaaactggggaacttgagtgcagaagaggaaagtggaattccaagtgtagcggtgaaatgcgtagagantttggaggaacaccagtggcgaaggcgactttctggtctgtaactgacactgaggcg

SEQ ID NO: 989 - DNA, 478 bp, Pseudomonas sp.
gccttcgggagctctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacag

SEQ ID NO: 990 - DNA, 725 bp, Pseudomonas sp.
  modified_base (5)..(5): a, c, t or g
  modified_base (676)..(676): a, c, t or g
  modified_base (701)..(701): a, c, t or g
  modified_base (704)..(704): a, c, t or g
  modified_base (709)..(709): a, c, t or g
  modified_base (723)..(723): a, c, t or g
gctangctggcggcgtgcttacacatgcaagtcgaacggtgaagccaagcttgcttggtggatcagtggcgaacgggtgagtaacacgtgagcaacctgccctggactctgggataagcgctggaaacggcgtctaatactggatatgagctcctatcgcatggtgggggttggaaagatttttcggtctgggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcggaagcctgatgcagcaacgccgcgtgagggatgacggccttcgggttgtaaacctcttttagcagggaagaagcgagagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatcccgaggctcaacctcgggcctgcagtgggtacgggcagactagagtgcggtaggggagattggaattcctggtgtagcggtggaatgcgcagatatcaggaggaacaccgatggcgaangcagatctctgggccgtaactgacnctnaagancgaaagggtggggnag

SEQ ID NO: 991 - DNA, 725 bp, Paenibacillus sp.
  modified_base (5)..(6): a, c, t or g
  modified_base (603)..(603): a, c, t or g
  modified_base (637)..(637): a, c, t or g
  modified_base (652)..(652): a, c, t or g
  modified_base (679)..(679): a, c, t or g
  modified_base (704)..(704): a, c, t or g
  modified_base (707)..(707): a, c, t or g
gctannctggcggcgtgcttacacatgcaagtcgaacggtgaacacggagcttgctctgtgggatcagtggcgaacgggtgagtaacacgtgagcaacctgcccctgactctgggataagcgctggaaacggcgtctaatactggatatgtgacgtgaccgcatggtctgcgtttggaaagatttttcggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatcccgaggctcaacctcgggcctgcagtgggtacgggcagactanagtgcggtaggggagattggaattcctggtgtancggtggaatgcgcanatttcaggaggaacaccgatggcgaangcagatctctgggccgtaactgacnctnaagaacgaaagggtgggg

SEQ ID NO: 992 - DNA, 725 bp, Staphylococcus sp.
  modified_base (5)..(6): a, c, t or g
  modified_base (703)..(703): a, c, t or g
  modified_base (706)..(706): a, c, t or g
  modified_base (708)..(708): a, c, t or g
  modified_base (711)..(711): a, c, t or g
gctannctggcggcgtgcttaccatgcaagtcgaacggtgaacacggagcttgctctgtgggatcagtggcgaacgggtgagtaacacgtgagcaacctgcccctgactctgggataagcgctggaaacggcgtctaatactggatatgtgacgtgaccgcatggtctgcgtttggaaagatttttcggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatcccgaggctcaacctcgggcctgcagtgggtacgggcagactagagtgcggtaggggagattggaattcctggtgtagcggtggaatgcgcagatatcaggaggaacaccgatggcgaaggcagatctctgggccgtacctgacnctnangancgaaagggtgggga

SEQ ID NO: 993 - DNA, 740 bp, Staphylococcus sp.
  modified_base (677)..(677): a, c, t or g
  modified_base (682)..(683): a, c, t or g
  modified_base (685)..(685): a, c, t or g
  modified_base (697)..(697): a, c, t or g
  modified_base (705)..(705): a, c, t or g
  modified_base (708)..(709): a, c, t or g
  modified_base (717)..(717): a, c, t or g
  modified_base (735)..(735): a, c, t or g
  modified_base (737)..(737): a, c, t or g
  modified_base (739)..(739): a, c, t or g
ctggcggcgtgcctaatacatgcaagtcgagcggacagaagggagcttgctcccggatgttagcggcggacgggtgagtaacacgtgggtaacctgcctgtaagactgggataactccgggaaaccggagctaataccggatagttccttgaaccgcatggttcaaggatgaaagacggtttcggctgtcacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgcaagagtaactgcttgcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactgggaaacttgagtgcagaagaggaggagtggaattccacgtgtagcggtgaaatgcgtaganaatgnngnaggaacaccagntggcgaanggnnactctctnggtctgtaactgacgctnangna

SEQ ID NO: 994 - DNA, 1534 bp, Microbacterium sp.
  modified_base (11)..(11): a, c, t or g
  modified_base (68)..(68): a, c, t or g
  modified_base (711)..(721): a, c, t or g
  modified_base (744)..(744): a, c, t or g
  modified_base (762)..(763): a, c, t or g
agagtttgatnatggctcagattgaacgctggcggcaggcctaacacatgcaagtcgagcggcagcgnaaagtagcttgctactttgccggcgagcggcggacgggtgagtaatgtctgggaaactgcctgatggagggggataactactggaaacggtagctaataccgcatgacctcgaaagagcaaagtgggggatcttcggacctcacgccatcggatgtgcccagatgggattagctagtaggtgaggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttagggttgtaaagcactttcagcgaggaggaaggcatcatacttaatacgtgtggtgattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgcgcttaacgtgggaactgcatttgaaactggcaagctagagtcttgtagaggggggtagaattccaggtgtagcggtgaaatgcgtagagatctggaggaatnnnnnnnnnnnaggcggccccctggacaaagacngacgctcaggtgcgaaanngtggggagcaaacaggattagataccctggtagtccacgctgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaattcgccagagatggcttagtgccttcgggaaccgtgagacaggtgctgcatggctgtcgtcagctcgtgttgtgaaatgttgggttaagtcccgcaacgagcgcaacccttatcctttgttgccagcacgtaatggtgggaactcaaaggagactgccggtgataaaccggaggaaggtggggatgacgtcaagtcatcatggcccttacgagtagggctacacacgtgctacaatggcatatacaaagagaagcgaactcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaacttcgggagggcgcttaccactttgtgattcatgactggggtgaagtcgtaacaaggtaaccgtaggggaactgcggttggatcacctcctta

SEQ ID NO: 995 - DNA, 661 bp, Frigoribacterium sp.
aacgctggccggcaggcctaactacatgcaagtcgcagcggtagcacagagagcttgctctcgggtgacgagcggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcgaggaggaaggcattgtggttaataaccacagtgattgacgttactcgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcgg

SEQ ID NO: 996 - DNA, 523 bp, Unknown
  source: /note="Description of Unknown: Uncultured proteobacterium"
agagtttgatcatggctcagattgaacgctggcggcaggcctaacacatgcaagtcgagcggatgaagagagcttgctctctgattcagcggcggacgggtgagtaatgcctaggaatctgcctggtagtgggggacaacgtctcgaaagggacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagtaagcgaataccttgctgttttgacgttaccgacagaataagcaccggctaactctgtgccagcagccgcggtaatac

SEQ ID NO: 997 - DNA, 525 bp, Paenibacillus sp.
agagtttgatcatggctcagattgaacgctggcggcaggcctaacacatgcaagtcgagcggcagcacgggtacttgtacctggtggcgagcggcggacgggtgagtaatgcctaggaatctgcctggtagtgggggataacgctcggaaacggacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagttacctaatacgtgattgttttgacgttaccgacagaataagcaccggctaactctgtgccagcagccgcggtaatac

SEQ ID NO: 998 - DNA, 523 bp, Sphingomonas  sp.
agagtttgatcatggctcagattgaacgctggcggcaggcctaacacatgcaagtcgagcggtagagagaagcttgcttctcttgagagcggcggacgggtgagtaatgcctaggaatctgcctggtagtgggggataacgttcggaaacggacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcattaacctaatacgttagtgttttgacgttaccgacagaataagcaccggctaactctgtgccagcagccgcggtaatac

SEQ ID NO: 999 - DNA, 1371 bp, Bacillus sp.
agtgggggataacgttcggaaacggacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggttgtacattaatactctgcaattttgacgttaccgacagaataagcaccggctaactctgtgccagcagccgcggtaatacagagggtgcaagcgttaatcggaattactgggcgtaaagcgcgcgtaggtggttcgttaagttggatgtgaaagccccgggctcaacctgggaactgcattcaaaactgacgagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttggaatccttgagattttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggagcattgagacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagcc

SEQ ID NO: 1000 - DNA, 846 bp, Pantoea ananatis
gaaacgactgctaagactggataggaaacagagaggcatctttttgtttttaaaagaccttcttcggagggtatgcttaaagaggggcttgcgccacattagttagttggtgaggtaaaggcttaccaagattatgatgtgtagctggactgagaggttgaacagccacattgggactgagacacggcccaaactcctacgggaggcagcagtagggaattttcggcaatggaggaaactctgaccgagcgacgccgcgtgaacgatgaagtatttcggtatgtaaagttcttttattgaagaagaaaaaatagtggaaaaactatcttgacgttattcaatgaataagccccggctaactatgtgccagcagccgcggtaagacatagggggcgagcgttatccggaattattgggcgtaaagggtgcgtaggcggttagataagtctataatttaatttcagtgcttaacgctgtcttgttatagaaactgtcttgactagagtgagataggggcaagcggaattccatgtgtagcggtaaaatgtgtaaatatatggaggaacaccagaagcgtagggcggcttgctgggtctttactgacgctgaggcacgaaagcgtggggagcaaacaggattagataccctggtagtccacgctgtaaacgatgagtactaagtgtcggggtaactcggtactgaagttaacacattaagtactccgcctgagtagtacgtacgcaagtatgaaacttaaaggaattgacgggactcgcacaagcggtggatcatgtgtttaattcgaagatacacgaagaaccttaccaggtcttgacatactctgcg

SEQ ID NO: 1001 - DNA, 860 bp, Microbacterium sp.
gaacgactcgctatagactggataggaaacagaaaggcatctttttgtttttaaaagaccttcttcggagggtatgcttaaagaggggcttgcgccacattagttagttggtgaggtaaaggcttaccaagattatgatgtgtagctggactgagaggttgaacagccacattgggactgagacacggcccaaactcctacgggaggcagcagtagggaattttcggcaatggaggaaactctgaccgagcgacgccgcgtgaacgatgaagtatttcggtatgtaaagttcttttattgaagaagaaaaaatagtggaaaaactatcttgacgttattcaatgaataagccccggctaactatgtgccagcagccgcggtaagacatagggggcgagcgttatccggaattattgggcgtaaagggtgcgtaggcggttagataagtctataatttaatttcagtgcttaacgctgtcttgttatagaaactgtcttgactagagtgagatagaggcaagcggaattccatgtgtagcggtaaaatgtgtaaatatatggaggaacaccagaagcgtaggcggcttgctgggtctttactgacgctgaggcacgaaagcgtggggagcaaacaggattagataccctgggtagtccacgctgtaaacgatgagtactaagtgtcggggtaactcgggtactgaagttaacacattaagtactccgcctgagtagtacgtacgcaagtatgaaacttaaaggaattgacgggactccgcacaagcgtggatcatgttgtttaattcgaagatacacgaaaaaccttaccaggtcttgacatactctggcaaagcttatag

SEQ ID NO: 1002 - DNA, 895 bp, Microbacterium sp.
ggggggctaaccatgcagtcggacggtagcacagagagcttgctctcgggtgacgagtggcggacgggtgagtaatgtctggggatctgcccgatagagggggataactactggaaacggtagctaataccgcatgacctcgtaagagcaaagtgggggaccttcgggcctcacgccatcggatgtgcccagatgggattagctagtaggtgaggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgcggttaataaccgcgtcgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtcttgtagaggggggtagaattccaggtgtagcggtgaaatgcgtagagatctggaggagtaccggtggcgaaggcggccccctggacaaagactgacgctcaggtgcgaaagcgtggggagcaaacaggattagataccctggtagtccacgccgtaacgatgtcgacttggaggttgttcccttgaggagtgcttccggagctaacgcgttaagtcgaccgcctgggggagtacggccgcaaggttaaaactcaaatgaatttgacgggggcccgcacaagc

SEQ ID NO: 1003 - DNA, 782 bp, Microbacterium sp.
gtcggacggtagcacagaggagtttgcttcttgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggtgaggtaatggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgcggttaataaccgcgtcgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtcttgtagaggggggtagaattccaggtgtagcggtgaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgttccctt

SEQ ID NO: 1004 - DNA, 739 bp, Bacillus pumilus
tggattagtggcgaacgggtgagtaacacgtgagtaacctgcccctgactctgggataagcgttggaaacgacgtctaatactggatatgatcactggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggt

SEQ ID NO: 1005 - DNA, 800 bp, Rahnella aquatilis
tgcattaccatgcagtcgacgatgatgcccagcttgctgggtggattagtggcgaacgggtgagtaacacgtgagtaacctgcccctgactctgggataagcgttggaaacgacgtctaatactggatatgatcactggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcatggggagcgaacaggattagataccctggtagtccatgccgtaaacgttgggcgctagatgtagggacctttccacggtttctgtgtcgtagctaacgc

SEQ ID NO: 1006 - DNA, 770 bp, Enterobacter sp.
tgcagtcgacgatgatgcccagcttgctgggtggattagtggcgaacgggtgagtaacacgtgagtaacctgcccctgactctgggataagcgttggaaacgacgtctaatactggatatgatcactggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacactcgatggcgaaggcagatctctgggctcgtaactgacgctgaggagcgaaagcatggggagcgaacaggattagatactctggctagtccatgccgtaaacgttgggcgctagatgtagggatcttttcca

SEQ ID NO: 1007 - DNA, 760 bp, Pseudomonas sp.
gtcgacgatgatgcccagcttgctgggtggattagtggcgaacgggtgagtaacacgtgagtaacctgcccctgactctgggataagcgttggaaacgacgtctaatactggatatgatcactggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcagaggaacaccgatggcgaaggcagatctctgggccgtaactgacgctgaggagcgaaagcgtggggagcgaacaggattagataccctggtagtccacgccgtaaacgttgggcgctagatgtagggaccttttc

SEQ ID NO: 1008 - DNA, 770 bp, Pseudomonas syringae
tgcagtcgacgatgatgcccagcttgctgggtggattagtggcgaacgggtgagtaacacgtgagtaacctgcccctgactctgggataagcgttggaaacgacgtctaatactggatatgatcactggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggctcgtaactgacgctgaggagcgaaagcatggggagcgaacaggattagataccctggtagtccatgccgtaaacgttgggcgctagatgtagggacctttccacgg

SEQ ID NO: 1009 - DNA, 747 bp, Pseudomonas sp.
ttgctactttgccggcgagcggcggacgggtgagtaatgtctgggaaactgcctgatggagggggataactactggaaacggtagctaataccgcatgacctcgtaagagcaaagtgggggaccttcgggcctcacgccatcggatgtgcccagatgggattagctagtaggtgaggtaatggctcacctaggcgacgatccctagctggtctgagaggatgaccagccacactggaactgagacacggtccagactcctacgggaggcagcagtggggaatattgcacaatgggcgcaagcctgatgcagccgtgccgcgtgtgtgaagaaggccttagggttgtaaagcactttcagcgaggaggaagggttcagtgttaatagcactgtgcattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgagcttaacttgggaactgcatttgaaactggcaagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttgg

SEQ ID NO: 1010 - DNA, 916 bp, Pseudomonas putida
tggttccagggtttgaaacgccctggcgccaggccttaacacattgcagttcgagcggcagcgggaggtaagctgctacttggccgtcggagccggcggacgggtgagtaagtctgggaactgcttgatggaggggggataactactggaacggtagctaataccggcatgacctcgcaagagcaaagtgggggaccttccgggcctcacgccatcggatgtgcccagatgggattagctagtaggtgaggtaatggctcacctaggcgacgatccctagctggtctgagaggatgaccagccacactggaactgagacacggtccagactctacgggaggcagcagtggggaatattgcacaatgggcgcaagcctgatgcagccatgccgcgtgtgtgaagaaggccttagggttgtaaagcactttcagcgaggaggaagggttcagtgttaatagcactgtgcattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgagcttaacttgggaactgcatttgaaactggcaagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgtgcccttgaggtgtggcttccggagctaacgcgttaagtcgaccgcctggggagtacggccgcaaggttcaaactcaaatgaattgacgg

SEQ ID NO: 1011 - DNA, 780 bp, Phytoplasma vitis
gtcgacggtagcacagagagcttgctcttgggtgacgagtggcggacgggtgagtaatgtctgggaaactgcccgatggagggggataactactggaaacggtagctaataccgcataacgtcttcggaccaaagtgggggaccttcgggcctcacaccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagtggggaggaaggcgaagaggttaataaccttttcgattgacgttacccgcagaagaagcaccggctaactccgtgccagcagccgcggtaatacggagggtgcaagcgttaatcggaattactgggcgtaaagcgcacgcaggcggtctgccaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgccctt

SEQ ID NO: 1012 - DNA, 783 bp, Phytoplasma vitis
gtcggacggtagcacagaggagcttgctccttgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaatggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgcggttaataaccgcgtcgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgttccctt

SEQ ID NO: 1013 - DNA, 894 bp, Pantoea agglomerans
ggacaagtcggacggtagcacagaggagcttgctccttgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaatggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgcggttaataaccgcgtcgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaacgatgtcgacttggaggttgttcccttgaggagtgcttccggagctacgcgttaagtcgaccgcctggggagtacggccgcaaggttaaactcaaatgaattgacgggggcccgcacaagcggtggagcatgt

SEQ ID NO: 1014 - DNA, 809 bp, Pantoea agglomerans
ggatccacgcattttgattctggctcaggttgaacgctggcggcaggcctaacacatgcaagtcggacggtagcacagaggagcttgctccttgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaatggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgcggttaataaccgcgtcgattgacgttacccgcagaagaagcaccggctaactccgtgccagcagccgcggtaatacggagggtgcaagcgttaatcggaattactgggcgtgaagcgcacgcaggcggtctgttaagtcagatgtgaaatccccgggcttaacctgggaactgcacttgaaactggcaggcttgagtcttgtagaggggggtagaattccaggtgtagcggtgaaatgcgtagagatctggaggaataccggtggcgaagcggctcctggacaagactgacgctcagtgcgaaagcgtggggagcaaacaggattagatactctggtagtccacgccc

SEQ ID NO: 1015 - DNA, 879 bp, Curtobacterium sp.
ggatccagcactttgatcctggctcaggttgaacgctggcggcaggcctaacacatgcaagtcggacggtagcacagaggagcttgctccttgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaatggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgcggttaataaccgcgtcgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtcttgtagaggggggtagaattccaggtgtagcggtgaaatgcgtagagatctggaggaataccggtggcgaagcggccccctggacaaagactgacgctcaggtgcgaaagcgtggggagcaaacaggattagataccctggtagtccacgccgtaacgatgtcgacttggaggttgttcccttgaggagtggcttccggagctaacggcgttaagtcgacc

SEQ ID NO: 1016 - DNA, 715 bp, Curtobacterium sp.
tgctataatgcagtcgagcgactgattagaagcttgcttctatgacgttagcggcggacgggtgagtaacacgtgggcaacctgcctgtaagactgggataacttcgggaaaccgaagctaataccggataggatcttctccttcatgggagatgattgaaagatggtttcggctatcacttacagatgggcccgcggtgcattagctagttggtgaggtaacggctcaccaaggcaacgatgcatagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtacgagagtaactgctcgtaccttgacggtacctaaccagaaagccacggctaactacgtgccagcagccgcggtaatacgtaggtggcaagcgttatccggaattattgggcgtaaagcgcgcgcaggcggtttcttaagtctgatgtgaaagcccacggctcaaccgtggagggtcattggaaactggggaacttgagtgcagaagagaaaagcggaattccacgtgtagcggtgaaatgcgtagagatgtggaagaacaccagttggcgaagcggcttttttggtctgtaactgacg

SEQ ID NO: 1017 - DNA, 647 bp, Curtobacterium sp.
gtcgagcgactgattagaagcttgcttctatgacgttagcggcggacgggtgagtaacacgtgggcaacctgcctgtaagactgggataacttcgggaaaccgaagctaataccggataggatcttctccttcatgggagatgattgaaagatggtttcggctatcacttacagatgggcccgcggtgcattagctagttggtgaggtaacggctcaccaaggcaacgatgcatagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtacgagagtaactgctcgtaccttgacggtacctaaccagaaagccacggctaactacgtgccagcagccgcggtaatacgtaggtggcaagcgttatccggaattattgggcgtaaagcgcgcgcaggcggtttcttaagtctgatgtgaaagcccacggctcaaccgtggagggtcattggaaactggggaacttgagtgcagaagagaaaagcggaacttccacgtgtagcggtgaaatgc

SEQ ID NO: 1018 - DNA, 555 bp, Curtobacterium sp.
ggcggcgtgcctatacatgcaagtcgaacgcttcttttcccaccggagcttgctccaccgggaaaagaggagtggcgaacgggtgagtaacacgtgggtaacctgcccatcagaaggggataacacttggaaacaggtgctaataccgtataacaatcgaaaccgcatggtttcgttttgaaaggcgctttacggtgccgctgatggatggacccgcggtgcattagctagttggtgaggtaacggctcaccaaggccacgatgcatagccgacctgagagggtgatcggccacattgggactgagacacggcccaaactcctacgggaggcagcagtagggaatcttcggcaatggacgaaagtttgaccgtgcaactccgcgagagtgaagaaggtttacgtatcgtaaaactctgttgttagagaaaatcaaaggtgagggtaggtatatttcccttgacggtatcttagatcttagctacagctatctactcgtgagggaccgcgtgatcacttttgtgttttgggtctaccccaatcgggggaccactcc

SEQ ID NO: 1019 - DNA, 423 bp, Curtobacterium sp.
ggggaattttccgcaatgggcgaaagcctgatggagcaacgccgcgtgcaggatgaaggctttcgggtcgtaaactgcttttatctgtgacgaatatgacggtagcagatgaataaggatcggctaactccgtgccagcagccgcggtcatacggaggatccaagcgttatccggaattactgggcgtaaagagttgcgtaggtggcattgtaagttggtagtgaaagcgttcggctcaaccgaatatccattaccaaaactgcaaagctagaggatgagagaggttattggaattcctagtgtaggagtgaaatccgtagatattaggaggaacaccgatggcgtaggcagataactggctcattcctgacactaaggcacgaaagcgtgggtagcaaatgggattagataccccagtagtc

SEQ ID NO: 1020 - DNA, 347 bp, Ewingella americana
ctggcttcgggtgttaccgactttcatgacttgacgggcggtgtgtacaaggcccgggaacgtattcaccgcagcgttgctgatctgcgattactagcgactccgacttcatgaggtcgagttgcagacctcaatccgaactgagaccggctttttgggattcgctccaccttacggtatcgcagccctttgtaccggccattgtagcatgcgtgaagcccaagacataaggggcatgatgatttgacgtcatccccaccttcctccgagttgaccccggcagtctcctatgagttcccaccataacgtgctggcaacatagaacgagggttgcgctcgttgcggga

SEQ ID NO: 1021 - DNA, 431 bp, Ewingella americana
  modified_base (10)..(10): a, c, t or g
ccttcgacgnctccctccacaagggttgggccaccggcttcaggtgttaccgactttcatgacttgacgggcggtgtgtacaagacccgggaacgtattcaccgcagcgttgctgatctgcgattactagcgactccgacttcatgaggtcgagttgcagacctcaatccgaactgggaccggctttttgggattcgctccacctcgcggtattgcagccctttgtaccggccattgtagcatgcgtgaagcccaagacataaggggcatgatgatttgacgtcatccccaccttcctccgagttgaccccggcagtatcccatgagttcccaccattacgtgctggcaacatagaacgagggttgcgctcgttgcgggacttaacccaacatctcacgacacgagctgacgacaaccatgcaccacctgt

SEQ ID NO: 1022 - DNA, 446 bp, Erwinia persicina
ttaccccaccgacttcgggtgttgtaaactctcgtggtgtgacgggcggtgtgtacaagacccgggaacgtattcaccgcggcatgctgatccgcgattactagcaattccgacttcatgcaggcgagttgcagcctgcaatccgaactgagaccggctttgctgggattggctccacctcgcggcttcgcttcccgttgtaccggccattgtagtacgtgtgtagcccaggtcataaggggcatgatgatttgacgtcatccccaccttcctccggtttgtcaccggcagtcactctagagtgcccagctcaacctgctggcaactaaagtcaagggttgcgctcgttgcgggacttaacccaacatctcacgacacgagctgacgacaaccatgcaccacctgtctcaactttccccgaagggcacctgatgcatctctgcttc

SEQ ID NO: 1023 - DNA, 400 bp, Pantoea agglomerans
acggctccctccacaagggttgggccccggcttcaggtgttaccgactttcatgacttgacgggcggtgtgtacaagacccgggaacgtattcaccgcagcgttgctgatctgcgattactagcgactccgacttcatgaggtcgagttgcagacctcaatccgaactgggaccggctttttgggattcgctccaccttacggtattgcagccctttgtaccggccattgtagcatgcgtgaagcccaagacataaggggcatgatgatttgacgtcatccccaccttcctccgagttgaccccggcagtatcccatgagttcccaccattacgtgctggcaacatagaacgagggttgcgctcgttgcgggacttaacccaacatctcacgacacgagc

SEQ ID NO: 1024 - DNA, 428 bp, Pantoea agglomerans
ttagctgcctcccttgcgggttagcgcactaccttcaggtaaaaccaactcccatggtgtgacgggcggtgtgtacaaggcccgggaacgtattcaccgtggcgtgctgatccacgattactagcgattccaacttcatgggctcgagttgcagagcccaatccgaactgagacggctttttgagatttgcgaagggttgccccttagcgtcccattgtcaccgccattgtagcacgtgtgtagcccagcccgtaagggccatgaggacttgacgtcatccccaccttcctcgcggcttatcaccggcagtctccttagagtgctcaactaaatggtagcaactaaggacgggggttgcgctcgttgcgggacttaacccaacatctcacgacacgagctgacgacagccatgcagcacctgtgctcc

SEQ ID NO: 1025 - DNA, 435 bp, Pantoea ananatis
agctgctttcggttaccgactttaggtacacccggctcccatggcttgacgggcggtgtgtgcaaggtccgggaacgtattcaccgtatcattgctgatatacgattactagcgattccagcttcatggagtcgagttgcagactccaatctgaactgagagcaggtttttgggattggcttcatatcgctatgttgcagccctttgtcctgcccattgtagcacgtgtgtagccctgggcataaaggccatgatgacttgacatcatcccctccttcctcacgccttacggcggcagtttcagtagagttcccagcattacctgttggcaactactgataggggttgcgctcgttgcgggacttaacccaacacctcacggcacgagctgacgacagccatgcagcaccttactatctgtgtattgctacaaaa

SEQ ID NO: 1026 - DNA, 433 bp, Pantoea ananatis
  modified_base (10)..(10): a, c, t or g
tagctgcctncttgcggttagcgcactaccttcgggtaaaaccaactcccatggtgtgacgggcggtgtgtacaaggcccgggaacgtattcaccgcggcatgctgatccgcgattactagcgattccaacttcatgcactcgagttgcagagtgcaatccgaactgagatggcttttggagattagctcacactcgcgtgctcgctgcccactgtcaccaccattgtagcacgtgtgtagcccagcccgtaagggccatgaggacttgacgtcatccccaccttcctctcggcttatcaccggcagtccccttagagtgcccaactgaatgctggcaactaagggcgagggttgcgctcgttgcgggacttaacccaacatctcacgacacgagctgacgacagccatgcagcacctgtctctgcgccaccg

SEQ ID NO: 1027 - DNA, 459 bp, Bacillus sp.
tagctgcctccttgcggttagcacactaccttcgggtaaaaccaactcccatggtgtgacgggcggtgtgtacaaggcccgggaacgtattcaccgcggcatgctgatccgcgattactagcgattccaacttcatgcactcgagttgcagagtgcaatccgaactgagatggcttttggagattagctcgacatcgctgtctcgctgcccactgtcaccaccattgtagcacgtgtgtagcccagcccgtaagggccatgaggacttgacgtcatccccaccttcctctcggcttatcaccggcagtccccttagagtgcccaactgaatgctggcaactaagggcgagggttgcgctcgttgcgggacttaacccaacatctcacgacacgagctgacgacagccatgcagcacctgtgctccggtccccgaagggaacactacatctctgtagcta

SEQ ID NO: 1028 - DNA, 422 bp, Bacillus sp.
cccttgcggttagactaacggcttctggagcagctcactcccatggtgtgacgggcggtgtgtacaaggcccgggaacgtattcaccgcagcatagctgatctgcgattactagcgattccgacttcatggagtcgagttgcagactccaatccggactgggatcggctttctgggattagctccacctcgcggtcttgcaaccctctgtaccgaccattgtagtacgtgtgtagccctggccgtaagggccatgatgacttgacgtcatccccaccttcctccggtttgtcaccggcagtctccttagagttcccgactttactcgctggcaactaaggacaagggttgcgctcgttgcgggacttaacccaacatctcacgacacgagctgacgacagccatgcagcacctgtgttccga

SEQ ID NO: 1029 - DNA, 476 bp, Enterococcus sp.
  modified_base (19)..(19): a, c, t or g
taccgtggttagctgcctncttgcggttagcacactaccttcgggtaaaaccaactcccatggtgtgacgggcggtgtgtacaaggcccgggaacgtattcaccgcggcatgctgatccgcgattactagcgattccaacttcatgcactcgagttgcagagtgcaatccgaactgagatggcttttggagattagctcgacatcgctgtctcgctgcccactgtcaccaccattgtagcacgtgtgtagcccagcccgtaagggccatgaggacttgacgtcatccccaccttcctctcggcttatcaccggcagtccccttagagtgcccaactgaatgctggcaactaagggcgagggttgcgctcgttgcgggacttaacccaacatctcacgacacgagctgacgacagccatgcagcacctgtgctccggtccccgaagggaacactacatctctgtagctagccgtgct

SEQ ID NO: 1030 - DNA, 452 bp, Enterococcus sp.
tagctgcctccttgcggttagcgcactaccttcgggtaaaaccaactcccatggtgtgacgggcggtgtgtacaaggcccgggaacgtattcaccgcggcatgctgatccgcgattactagcgattccaacttcatgcactcgagttgcagagtgcaatccgaactgagatggcttttggagattagctcgacatcgctgtctcgctgcccactgtcaccaccattgtagcacgtgtgtagcccagcccgtaagggccatgaggacttgacgtcatccccaccttcctctcggcttatcaccggcagtccccttagagtgcccaactaaatgctggcaactaagggcgagggttgcgctcgttgcgggacttaacccaacatctcacgacacgagctgacgacagccatgcagcacctgtgtcccggtccccgaagggaaccctgcatctct

SEQ ID NO: 1031 - DNA, 475 bp, Unknown
  source: /note="Description of Unknown: Uncultured seed derived bacterium of the family Xanthomonadaceae"
aagcgccctcccgaaggttaagctacctgcttctggtgcaacaaactcccatggtgtgacgggcggtgtgtacaaggcccgggaacgtattcaccgcagcaatgctgatctgcgattactagcgattccgacttcatggagtcgagttgcagactccaatccggactgagatagggtttctgggattggcttaccgtcgccggcttgcagccctctgtccctaccattgtagtacgtgtgtagccctggccgtaagggccatgatgacttgacgtcatccccaccttcctccggtttgtcaccggcggtctccttagagttcccaccattacgtgctggcaactaaggacaagggttgcgctcgttgcgggacttaacccaacatctcacgacacgagctgacgacagccatgcagcacctgtgttcgagttcccgaaggcaccaatccatctctggaaagttctcgacatgtca

SEQ ID NO: 1032 - DNA, 680 bp, Unknown
  source: /note="Description of Unknown: Uncultured seed derived bacterium of the family Enterobacteriaceae"
ctacttcttttgcaacccactcccatggtgtgacgggcggtgtgtacaaggcccgggaacgtattcaccgtagcattctgatctacgattactagcgattccgacttcatggagtcgagttgcagactccaatccggactacgacgcactttatgaggtccgcttgctctcgcgaggtcgcttctctttgtatgcgccattgtagcacgtgtgtagccctactcgtaagggccatgatgacttgacgtcatccccaccttcctccagtttatcactggcagtctcctttgagttcccggccgaaccgctggcaacaaaggataagggttgcgctcgttgcgggacttaacccaacatttcacaacacgagctgacgacagccatgcagcacctgtctcagagttcccgaaggcaccaatccatctctggaaagttctctggatgtcaagagtaggtaaggttcttcgcgttgcatcgaattaaaccacatgctccaccgcttgtgcgggcccccgtcaattcatttgagttttaaccttgcggccgtactccccaggcggtcgacttaacgcgttagctccggaagccacgcctcaagggcacaacctccaagtcgacatcgtttacggcgtggactaccagggtatctaatcctgtttgctccccacgctttcgcacct

SEQ ID NO: 1033 - DNA, 459 bp, Unknown
  source: /note="Description of Unknown: Uncultured seed derived bacterium of the family Burkholderiaceae"
  modified_base (21)..(21): a, c, t or g
gaccgtcctccttgcggttangactaagccacttctggtaaaacccactcccatggtgtgacgggcggtgtgtacaagacccgggaacgtattcaccgcggcatgctgatccgcgattactagcgattccagcttcatgcactcgagttgcagagtgcaatccggactacgatcggttttctgggattagctccccctcgcgggttggcaaccctctgttccgaccattgtatgacgtgtgaagccctacccataagggccatgaggacttgacgtcatccccaccttcctccggtttgtcaccggcagtctccttagagtgctcttgcgtagcaactaaggacaagggttgcgctcgttgcgggacttaacccaacatctcacgacacgagctgacgacagccatgcagcacctgtgcgccggttctctttcgagcactcccacctctcagcaggatt

SEQ ID NO: 1034 - DNA, 407 bp, Unknown
  source: /note="Description of Unknown: Uncultured seed derived bacterium of the family Oxalobacteraceae"
gagcgccctccttgcggttaggctacccacttctggtaaaacccgctcccatggtgtgacgggcggtgtgtacaagacccgggaacgtattcaccgcgacatgctgatccgcgattactagcgattccaacttcatggagtcgagttgcagactccaatccggactacgatacactttctgggattagctccccctcgcgggttggcggccctctgtatgtaccattgtatgacgtgtgaagccctacccataagggccatgaggacttgacgtcatccccaccttcctccggtttgtcaccggcagtctcattagagtgccctttcgtagcaactaatgacaagggttgcgctcgttgcgggacttaacccaacatctcacgacacgagctgacgacagccatgca

SEQ ID NO: 1035 - DNA, 400 bp, Unknown
  source: /note="Description of Unknown: Uncultured seed derived bacterium of the family Enterobacteriaceae"
ccaggatcaaactctactacttcttttgcaacccactcccatggtgtgacgggcggtgtgtacaaggcccgggaacgtattcaccgtggcattctgatccacgattactagcgattccgacttcatggagtcgagttgcagactccaatccggactacgacatactttatgaggtccgcttgctctcgcgaggtcgcttctctttgtatatgccattgtagcacgtgtgtagccctggtcgtaagggccatgatgacttgacgtcatccccaccttcctccagtttatcactggcagtctcctttgagttcccggcccggaccgctggcaacaaaggataagggttgcgctcgttgcgggacttaacccaacatttcacaacacgagctgacgacagcca

SEQ ID NO: 1036 - DNA, 408 bp, Unknown
  source: /note="Description of Unknown: Uncultured seed derived bacterium of the family Weeksellaceae"
taggcagctcctgttacggtcaccgacttcaggtaccccagacttccatggcttgacgggcggtgtgtacaaggcccgggaacgtattcaccgcgccatggctgatgcgcgattactagcgattccagcttcatagagtcgagttgcagactccaatccgaactgagaccggctttcgagatttgcatcacatcgctgtgtagctgccctctgtaccggccattgtattacgtgtgtggcccaaggcgtaagggccgtgatgatttgacgtcatccccaccttcctctctacttgcgtaggcagtctcactagagtccccaactgaatgatggcaactagtgacaggggttgcgctcgttgcaggacttaacctaacacctcacggcacgagctgacgacaaccatgc

SEQ ID NO: 1037 - DNA, 418 bp, Unknown
  source: /note="Description of Unknown: Uncultured seed derived bacterium of the family Sphingomonadaceae"
ctctcttgcgagttagcgcaacgccttcgggtgaatccaactcccatggtgtgacgggcggtgtgtacaaggcctgggaacgtattcaccgcggcatgctgatccgcgattactagcgattccgccttcatgcactcgagttgcagagtacaatccgaactgagacaacttttggagattagctcaccctcgcgggattgctgcccactgtagttgccattgtagcacgtgtgtagcccagcgcgtaagggccatgaggacttgacgtcatccccaccttcctccggcttatcaccggcggttcctttagagtacccaactaaatgatggtaactaaaggcgagggttgcgctcgttgcgggacttaacccaacatctcacgacacgagctgacgacagccatgcagcacctgtgtgt

SEQ ID NO: 1038 - DNA, 473 bp, Unknown
  source: /note="Description of Unknown: Uncultured seed derived bacterium of the family Micrococcaceae"
ccttcgacggctccctccacaagggttgggccaccggcttcgggtgttaccgactttcgtgacttgacgggcggtgtgtacaaggcccgggaacgtattcaccgcagcgttgctgatctgcgattactagcgactccgacttcatgaggtcgagttgcagacctcaatccgaactgagaccggctttttgggattagctccacctcacagtatcgcaaccctttgtaccggccattgtagcatgcgtgaagcccaagacataaggggcatgatgatttgacgtcatccccaccttcctccgagttgaccccggcagtctcccatgagtccccaccatcacgtgctggcaacatggaacgagggttgcgctcgttgcgggacttaacccaacatctcacgacacgagctgacgacaaccatgcaccacctgtataccgaccccaaaggggaagaaccatctctggaacgccgct

SEQ ID NO: 1039 - DNA, 428 bp, Unknown
  source: /note="Description of Unknown: Uncultured seed derived bacterium of the family Burkholderiaceae"
ggtgaccgtcctccttgcggttagactagccacttctggtaaaacccactcccatggtgtgacgggcggtgtgtacaagacccgggaacgtattcaccgcggcatgctgatccgcgattactagcgattccagcttcatgcactcgagttgcagagtgcaatccggactacgatcggttttctgggattagctccccctcgcgggttggcaaccctctgttccgaccattgtatgacgtgtgaagccctacccataagggccatgaggacttgacgtcatccccaccttcctccggtttgtcaccggcagtctccttagagtgctcttgcgtagcaactaaggacaagggttgcgctcgttgcgggacttaacccaacatctcacgacacgagctgacgacagccatgcagcacctgtgcgccggttc

SEQ ID NO: 1040 - DNA, 443 bp, Unknown
  source: /note="Description of Unknown: Uncultured seed derived bacterium of the family Microbacteriaceae"
cttcgacggctccctccacaagggttaggccaccggcttcaggtgttaccgactttcatgacttgacgggcggtgtgtacaagacccgggaacgtattcaccgcagcgttgctgatctgcgattactagcgactccgacttcatgaggtcgagttgcagacctcaatccgaactgggaccggctttttgggattcgctccacctcacggtattgcagccctttgtaccggccattgtagcatgcgtgaagcccaagacataaggggcatgatgatttgacgtcatccccaccttcctccgagttgaccccggcagtatcccatgagttcccaccattacgtgctggcaacatagaacgagggttgcgctcgttgcgggacttaacccaacatctcacgacacgagctgacgacaaccatgcaccacctgtatacgagtgtcca

SEQ ID NO: 1041 - DNA, 463 bp, Unknown
  source: /note="Description of Unknown: Uncultured seed derived bacterium of the family Sphingobacteriaceae"
accctaggacgctccttgcggctacgtactttaggtacccccagcttccatggcttgacgggcggtgtgtacaaggcccgggaacgtattcaccgcgtcattgctgatacgcgattactagcgaatccaacttcaagaggtcgagttgcagacctctatccgaactgtgatcggctttttgagattggcattccattgctggatagctgccctctgtaccgaccattgtagcacgtgtgtagccccggacgtaagggccatgatgacttgacgtcgtcccctccttcctctctgtttgcacaggcagtctgtctagagtccccaccattacatgctggcaactagacataggggttgcgctcgttgcgggacttaacccaacacctcacggcacgagctgacgacagccatgcagcacctagtttcgtgtgattgctcactgtcccatctctggaacattcac

SEQ ID NO: 1042 - DNA, 466 bp, Unknown
  source: /note="Description of Unknown: Uncultured seed derived bacterium of the family Pseudomonadaceae"
acaccgcggtaaccgtccccccgaaggttagactagctacttctggtgcaacccactcccatggtgtgacgggcggtgtgtacaaggcccgggaacgtattcaccgcgacattctgattcgcgattactagcgattccgacttcacgcagtcgagttgcagactgcgatccggactacgatcggttttatgggattagctccacctcgcggcttggcaaccctctgtaccgaccattgtagcacgtgtgtagcccaggccgtaagggccatgatgacttgacgtcatccccaccttcctccggtttgtcaccggcagtctccttagagtgcccaccattacgtgctggtaactaaggacaagggttgcgctcgttacgggacttaacccaacatctcacgacacgagctgacgacagccatgcagcacctgtctcaatgttcccgaaggcaccaatccatctctgg

SEQ ID NO: 1043 - DNA, 430 bp, Unknown
  source: /note="Description of Unknown: Uncultured seed derived bacterium of the family Oxalobacteraceae"
  modified_base (20)..(20): a, c, t or g
  modified_base (24)..(24): a, c, t or g
gtaagcgccctccttgcggntaanctacctacttctggtaaaacccgctcccatggtgtgacgggcggtgtgtacaagacccgggaacgtattcaccgcgacatgctgatccgcgattactagcgattccaacttcatgcagtcgagttgcagactacaatccggactacgatacactttctgggattagctccccctcgcgggttggcggccctctgtatgtaccattgtatgacgtgtgaagccctacccataagggccatgaggacttgacgtcatccccaccttcctccggtttgtcaccggcagtctcattagagtgctctttcgtagcaactaatgacaagggttgcgctcgttgcgggacttaacccaacatctcacgacacgagctgacgacagccatgcagcacctgtgtgcaggttctct

SEQ ID NO: 1044 - DNA, 426 bp, Unknown
  source: /note="Description of Unknown: Uncultured seed derived bacterium of the family Micromonosporaceae"
cggctccctccacaagggttgggccaccggcttcgggtgttgccgactttcgtgacgtgacgggcggtgtgtacaaggcccgggaacgtattcaccgcagcgttgctgatctgcgattactagcgactccgacttcacggggtcgagttgcagaccccgatccgaactgagaccggctttttgggattcgctccacctcacggcatcgcaacccattgtaccggccattgtagcatgcgtgaagccctggacataaggggcatgatgacttgacgtcatccccaccttcctccgagttgaccccggcagtcttcgatgagtccccgccataacgcgctggcaacatcgaacgagggttgcgctcgttgcgggacttaacccaacatctcacgacacgagctgacgacagccatgcaccacctgtga

SEQ ID NO: 1045 - DNA, 438 bp, Unknown
  source: /note="Description of Unknown: Uncultured seed derived bacterium of the family Microbacteriaceae"
cttcgacggctccctccacaagggttgggccaccggcttcgggtgttaccgactttcatgacttgacgggcggtgtgtacaaggcccgggaacgtattcaccgcagcgttgctgatctgcgattactagcgactccgacttcatgaggtcgagttgcagacctcaatccgaactgagaccggctttttgggattcgctccaccttacggtattgcagccctttgtaccggccattgtagcatgcgtgaagcccaagacataaggggcatgatgatttgacgtcatccccaccttcctccgagttgaccccggcagtctcctatgagttcccgccataacgcgctggcaacatagaacgagggttgcgctcgttgcgggacttaacccaacatctcacgacacgagctgacgacaaccatgcaccacctgtatacgagt

SEQ ID NO: 1046 - DNA, 447 bp, Unknown
  source: /note="Description of Unknown: Uncultured seed derived bacterium of the family Burkholderiaceae"
ctaccgtggtgaccgtcctccttgcggttagactagccacttctggtaaaacccactcccatggtgtgacgggcggtgtgtacaagacccgggaacgtattcaccgcggcatgctgatccgcgattactagcgattccagcttcacgcagtcgagttgcagactgcgatccggactacgatcggttttctgggattggctccacctcgcggcttggcaaccctctgttccgaccattgtatgacgtgtgaagccctacccataagggccatgaggacttgacgtcatccccaccttcctccggtttgtcaccggcagtctccctagagtgctcttgcgtagcaactagggacaagggttgcgctcgttgcgggacttaacccaacatctcacgacacgagctgacgacagccatgcagcacctgtgttacggctccctttcgggcac

SEQ ID NO: 1047 - DNA, 418 bp, Unknown
  source: /note="Description of Unknown: Uncultured seed derived bacterium"
  modified_base (22)..(22): a, c, t or g
  modified_base (28)..(28): a, c, t or g
  modified_base (173)..(173): a, c, t or g
  modified_base (206)..(206): a, c, t or g
aaccctgcctccttgcggttangctcangcgcttctggagcaaacgactcccatggtgtgacgggcggtgtgtacaaggcccgggaacgtattcaccgctgcctgctgatcagcgattactagcgattccgacttcaaagagtcgagttgcagactcttatctgtactgaggncgggtttttgcgattggcttcccctcgcggggncgcatcgctttggccgaccattgtagcacgtgtgtagccctggacataagggccatgatgacttgacgtcatccccaccttcctccgatttgaatatcggcggtctcactagagttcccggcatgacccgatggcaactagtgataggggttgcgctcgttgcgggacttaacccaacatctcacgacacgagctgacgacagccatgcagc

SEQ ID NO: 1048 - DNA, 468 bp, Unknown
  source: /note="Description of Unknown: Uncultured seed derived bacterium"
  modified_base (117)..(117): a, c, t or g
  modified_base (130)..(130): a, c, t or g
  modified_base (150)..(150): a, c, t or g
  modified_base (312)..(312): a, c, t or g
  modified_base (345)..(345): a, c, t or g
  modified_base (372)..(372): a, c, t or g
  modified_base (389)..(389): a, c, t or g
  modified_base (464)..(464): a, c, t or g
tgcctccttgcggttagcgcgacgccttcgggtaaacccaactcccatggtgtgacgggcggtgtgtacaaggcccgggaatgtattcaccgtggcatgctgatccacgattactancgattccaccttnatgcactctagttgcagagngcaatctgaactgagacggctttttgggattagctcgaggtcgccctttcgctgcccattgtcaccgccattgtagcacgtgtgtagcccagcctgtaagggccatgaggacttgacgtcatccccaccttcctcgcggcttatcaccggcagtccccctanagttcccaacttaatgatggcaactatagggcnagggttgcgctctttgcgggacttaanccaacattttcgaacanagctgacgacagccatgcagcacctgtgttccggccagccgaactgaagaaaggcatctttgccgatcaaacctnacgt

SEQ ID NO: 1049 - DNA, 389 bp, Unknown
  source: /note="Description of Unknown: Uncultured seed derived bacterium of the family Caulobacteraceae"
taccgtggtcgcctgcctccttgcggttaagcgcagcgccttcgggtagaaccaactcccatggtgtgacgggcggtgtgtacaaggcccgggaacgtattcaccgcggcatgctgatccgcgattactagcgattccaacttcatgccctcgagttgcagaggacaatccgaactgagacgacttttagggatttgccctctgtagtcgccattgtagcacgtgtgtagcccaccctgtaagggccatgaggacttgacgtcatccccaccttcctccggcttagcaccggcagtcctgttagagttcccaactaaatgatggcaactaacagcgagggttgcgctcgttgcgggacttaacccaacatctcacgacacgagctgacg

SEQ ID NO: 1050 - DNA, 458 bp, Unknown
  source: /note="Description of Unknown: Uncultured seed derived bacterium of the family Oxalobacteraceae"
cgtggtaatcgccctccttgcggttaggctaactacttctggtaaagcccactcccatggtgtgacgggcggtgtgtacaagacccgggaacgtattcaccgcggcatgctgatccgcgattactagcgattccagcttcacgtagtcgaattgcagactacgatccggactacgatgcattttctgggattagctccacctcgcggcttggcaaccctctgtatgcaccgttgtatgacgtgtgaagccctacccataagggccatgaggacttgacgtcatccccaccttcctccggtttgtcaccggcagtctctctagagtgccctttcgtagcaactagagacaagggttgcgctcgttgcgggacttaacccaacatctcacgacacgagctgacgacagccatgcagcacctgtgtccactttctctttcgagcacctaatgcatctctgc

SEQ ID NO: 1051 - DNA, 429 bp, Unknown
  source: /note="Description of Unknown: Uncultured seed derived bacterium of the family Burkholderiaceae"
ctaccgtggtgaccgtcctccttgcggttagactagccacttctggtaaaacccactcccatggtgtgacgggcggtgtgtacaagacccgggaacgtattcaccgcggcatgctgatccgcgattaccagcgattccagcttcacgcagtcgagttgcagaccgcgatccggactacgatcggttttctgggattggctccacctcgcggcttggcaaccctctgttccgaccattgtatgacgtgtgaagccctacccataagggccatgtggacttgacgtcatccccaccttcctccggtttgtcaccggcagtctccctagagtgctcttgcgtagcaactagggacaagggttgcgctcgttgcgggacttaacccaacatctcacgacacgagctgacgacagccatgcagcacctgtgtta

SEQ ID NO: 1052 - DNA, 498 bp, Unknown
  source: /note="Description of Unknown: Uncultured seed derived bacterium of the family Rhizobiaceae"
cggtcgcctgcctcccttgcgggttagcgcagcgccttcgggtaaaaccaactcccatggtgtgacgggcggtgcgtacaaggcccgggaacgtattcaccgtggcatgctgatccacgattactagcgattccaacttcatgcactcgagttgcagagtgcaatccgaactgagacggctttttgggattagcttctcctcgcgaagtagctgcccactgtcaccgccattgtagcacgtgtgtagcccagcccgtaagggccatgaggacttgacgtcatccccaccttcctctcggcttatcaccggcagtccctctagagtgcccaacttaatgatggcaactagaggcgagggttgcgctcgttgcgggacttaacccaacatctcacgacacgagctgacgacagccatgcagcacctgtgttcacgccagccgaactgaagaaatccgtctccggaattcatacgtgacatgtcaagagctggtaaggttc

SEQ ID NO: 1053 - DNA, 439 bp, Unknown
  source: /note="Description of Unknown: Uncultured seed derived bacterium of the family Burkholderiaceae"
atcccaccgtggtaagcgccctccttgcggttaggctacctacttctggtgaaacccactcccatggtgtgacgggcggtgtgtacaagacccgggaacgtattcaccgcggcatgctgatccgcgattactagcgattccagcttcacgcactcgagttgcagagtgcgatccggactacgatcggttttctgggattggctccccctcgcgggttggcgaccctctgttccgaccattgtatgacgtgtgaagccctacccataagggccatgaggacttgacgtcatccccaccttcctccggtttgtcaccggcagtctccctggagtgctcttgcgtagcaactagggacaagggttgcgctcgttgcgggacttaacccaacatctcacgacacgagctgacgacagccatgcagcacctgtgttatggctcc

SEQ ID NO: 1054 - DNA, 429 bp, Unknown
  source: /note="Description of Unknown: Uncultured seed derived bacterium of the family Rhodospirillaceae"
ctaccgtggtcggctgcctccttgcggttagcgcaccggcttcgggtagaaccaactcccatggtgtgacgggcggtgtgtacaaggcccgggaacgtattcaccgcgccatgctgatgcgcgattactagcgattccaacttcatgtactcgagttgcagagtacaatccgaactgagatggctttttgagattagcttggcgtcaccgcctcgcgacccattgtcaccaccattgtagcacgtgtgtagcccaacccgtaagggccatgaggacttgacgtcatccccgccttcctccggcttgtcaccggcagtttctccagagtgcccaactaaatgatggcaactgaagatgggggttgcgctcgttgcgggacttaacccaacatctcacgacacgagctgacgacagccatgcagcacctgt

SEQ ID NO: 1055 - DNA, 406 bp, Unknown
  source: /note="Description of Unknown: Uncultured seed derived bacterium of the family Burkholderiaceae"
ctaccgtggggaccgtcttccttgcggttaaactagccacttctggtaaaacccactcccatggtgtgacgggcggtgtgtacaagacccgggaacgtattcaccgcggcatgctgttccgcgattactagcgattccagcttcatgcagtcgagttgcagactgcaatccggactacgatcggctttctgggattggctcaccttcgcagggtcgctgccctctggaccgaccattgtatgacgtgtgaagccctacccgtaagggccatgaggacttgacgtcatccccaccttcctccggcttgtcaccggcagtctccttagagtgccctcgcgtagcaaataaggataagggttgcgctcgttgcgggacttaacccaacatctcacgacacgagctgacg

SEQ ID NO: 1056 - DNA, 419 bp, Unknown
  source: /note="Description of Unknown: Uncultured seed derived bacterium"
cttcggcagctccctccttgcggttgggtcactgacttcgggcatattagactcccatggtgtgacgggcggtgtgtacaagacccgggaacgtattcaccacgacattctgattcgcgattactagcgattccagcttcatgtagtcgagttgcagactacaatccgaactgagatgacctttttgagatttgctccacttcgcagtcttgcttctctttgtagtcaccattgtagcacgtgtgtagcccagatcataaggggcatgatgatttgacgtcatccccaccttcctccaggttatccctggcagtctctctagagtgcccatccaaaatgctggctactaaagataggggttgcgctcgttgcgggacttaacccaacatctcacgacacgagctgacgacaaccatgca

SEQ ID NO: 1057 - DNA, 448 bp, Unknown
  source: /note="Description of Unknown: Uncultured seed derived bacterium of the family Rhizobiaceae"
taccgtggttagctgcctccttgcggttagcgcactaccttcgggtaaaaccaactcccatggtgtgacgggcggtgtgtacaaggcccgggaatgtattcaccgcggcatgctgatccgcgattactagcgattccaacttcatgcactcgagttgcagagtgcaatccgaactgagatggcttttggagattagctcacactcgcgtgctcgctgcccactgtcaccaccattgtagcacgtgtgtagctcagcccgtaagggccatgaggacttgacgtcatccccaccttcctctcggcttatcaccggcagtccccttagagtgcccaactgaatgctggcaactaagggcgagggttgcgctcgttgcgggacttaacccaacatctcacgacacgagctgacgacagccatgcagcacctgtctctgcgccaccgaagtgg

SEQ ID NO: 1058 - DNA, 439 bp, Unknown
  source: /note="Description of Unknown: Uncultured seed derived bacterium of the family Xanthomonadaceae"
  modified_base (4)..(4): a, c, t or g
tccnggtcgtcgtcccccttgcggttagactaacggcttctggagcagctcactcccatggtgtgacgggcggtgtgtacaaggcccgggaacgtattcaccgcagcatagctgatctgcgattactagcgattccgacttcatggagtcgagttgcagactccaatccggactgggatcggctttctgggattagctccacctcgcggtcttgcaaccctctgtaccgaccattgtagtacgtgtgtagccctggccgtaagggccatgatgacttgacgtcatccccaccttcctccggtttgtcaccggcagtctccttagagttcccgactttactcgctggcaactaaggacaagggttgcgctcgttgcgggacttaacccaacatctcacgacacgagctgacgacagccatgcagcacctgtgttccgatt

SEQ ID NO: 1059 - DNA, 426 bp, Unknown
  source: /note="Description of Unknown: Uncultured seed derived bacterium of the family Xanthomonadaceae"
caccgtggctagcgccctcccgaaggttaagctacctgcttctggtgcaacaaactcccatggtgtgacgggcggtgtgtacaaggcccgggaacgtattcaccgcagcaatgctgatctgcgattactagcgattccgacttcatggagtcgagttgcagactccaatccggactgagatagggtttctgggattggctcaccctcgcgggtttgcagccctctgtccctaccattgtagtacgtgtgtagccctggtcgtaagggccatgatgacttgacgtcatccccaccttcctccggtttgtcaccggcggtctccttagagttcccaccattacgtgctggcaactaaggacaagggttgcgctcgttgcgggacttaacccaacatctcacgacacgagctgacgacagccatgcagc

SEQ ID NO: 1060 - DNA, 433 bp, Unknown
  source: /note="Description of Unknown: Uncultured seed derived bacterium of the family Burkholderiaceae"
aatcctaccgtggggaccgtcttccttgcggttaaactagccacttctggtaaaacccactcccatggtgtgacgggcggtgtgtacaagacccgggaacgtattcaccgcggcatgctgttccgcgattactagcgattccagcttcatgcagtcgagttgcagactgcaatccggactacgatcggctttctgggattggctcaccttcgcagggtcgctgccctctggaccgaccattgtatgacgtgtgaagccctacccgtaagggccatgaggacttgacgtcatccccaccttcctccggcttgtcaccggcagtctccttagagtgccctcgcgtagcaaataaggataagggttgcgctcgttgcgggacttaacccaacatctcacgacacgagctgacgacagccatgcagcacctgtgtgt

SEQ ID NO: 1061 - DNA, 434 bp, Unknown
  source: /note="Description of Unknown: Uncultured seed derived bacterium of the family Bacillaceae"
ccttaggcggctagctccttacggttactccaccgacttcgggtgttacaaactctcgtggtgtgacgggcggtgtgtacaaggcccgggaacgtattcaccgcggcatgctgatccgcgattactagcgattccagcttcatgtaggcgagttgcagcctacaatccgaactgagaatggttttatgggattggcttgacctcgtggtcttgcagccctttgtaccatccattgtagcacgtgtgtagcccaggtcataaggggcatgatgatttgacgtcatccccaccttcctccggtttgtcaccggcagtcaccttagagtgcccaactaaatgctggcaactaagatcaagggttgcgctcgttgcggacttaacccaacatctcacgacacgagctgacgacaaccatgcaccacctgtcactctgt

SEQ ID NO: 1062 - DNA, 431 bp, Unknown
  source: /note="Description of Unknown: Uncultured seed derived bacterium of the family Coxiellaceae"
acagcgacctccttacggttagtcgactggcgtctggtaaaacccactcccatggtgtgacgggcggtgtgtacaaggcccgagaacgtattcaccgcaacgtgctgatttgcgattactagcgattccagcttcatggagtcgagttgcagactccaatccggactacgagatattttgaagattagctccccctcgcgggttggcgactcattgtataccccattgtagcacgtgtgttgccctacccataaaggccatgatgacttgacatcatcctccccttcctccagcttatcactggcagtctccctcgagtactcaagcttacctgtagcaacaagggataagggttgcgctcgttacgggacttaacccaacatctcacgacacgagctgacgacagccatgcagcacctgtctctgagctc

SEQ ID NO: 1063 - DNA, 419 bp, Unknown
  source: /note="Description of Unknown: Uncultured seed derived bacterium of the family Bradyrhizobiaceae"
ctaccgtggccggctgcctccttgcggttagcgcaccgtcttcaggtaaaaccaactcccatggtgtgacgggcggtgtgtacaaggcccgggaacgtattcaccgtggcgtgctgatccacgattactagcgattccaacttcatgggctcgagttgcagagcccaatccgaactgagacggctctttgagatttgcgaagggtcgccccttagcatcccattgtcaccgccattgtagcacgtgtgtagcccagcccgtaagggccatgaggacttgacgtcatccccaccttcctcgcggcttatcaccggcagtctccttagagtgctcaactaaatggtagcaactaaggacgggggttgcgctcgttgcgggacttaacccaacatctcacgacacgagctgacgacagccat

SEQ ID NO: 1064 - DNA, 399 bp, Unknown
  source: /note="Description of Unknown: Uncultured seed derived bacterium of the family Paenibacillaceae"
ccttcggcggctggccccttgcggttaccccaccgacttcgggtgttgtaaactctcgtggtgtgacgggcggtgtgtacaagacccgggaacgtattcaccgcggcatgctgatccgcgattactagcaattccgacttcatgcaggcgagttgcagcctgcaatccgaactgagaccggcttctaaggattggctccacctcgcggcttcgcttcccgttgtaccggccattgtagtacgtgtgtagcccaggtcataaggggcatgatgatttgacgtcatccccgccttcctccggtttgtcaccggcagtcactctagagtgcccaactcaatgctggcaactaaagtcaagggttgcgctcgttgcgggacttaacccaacatctcacgacac

SEQ ID NO: 1065 - DNA, 439 bp, Unknown
  source: /note="Description of Unknown: Uncultured seed derived bacterium of the family Chitinophagaceae"
ccctaggcggctccttgcggttaccgactttaggtacacccagcttccatggcttgacgggcggtgtgtgcaaggtccgggaacgtattcaccgtatcattgctgatatacgattactagcgattccagcttcacgcagtcgagttgcagactgcgatctgaactgagaaagggtttttgagattagcgccttgtcaccaagtggcagctcgttgtcccttccattgtagcacgtgtgtagccctgggcataaaggccatgatgacttgacatcatcccctccttcctcgcgtcttacgacggcagtttcattagagttcccagctttacctgatggcaactaatgatgggggttgcgctcgttgcgggacttaacccaacacctcacggcacgagctgacgacagccatgcagcaccttacagactgtgtattgctac

SEQ ID NO: 1066 - DNA, 429 bp, Unknown
  source: /note="Description of Unknown: Uncultured seed derived bacterium of the family Planococcaceae"
ccttcggcggctggctcccgtaagggttaccccaccgacttcgggtgttacaaactctcgtggtgtgacgggcggtgtgtacaagacacgggaacgtattcaccgtggcatgctgatccacgattactagcgattccggcttcatgcaggcgagttgcagcctacaatccgaactgggaacggttttatgggattggctccccctcgcgggttggctaccctctgtaccgtccattgtagcacgtgtgtagcccaggtcataaggggcatgatgatttgacgtcatccccaccttcctccggtttgtcaccggcagtcaccttagagtgcccaactgaatgctggcaactaagatcaagggttgcgctcgttgcgggacttaacccaacatctcacgacacgagctgacgacaaccatgcaccacctgt

SEQ ID NO: 1067 - DNA, 399 bp, Unknown
  source: /note="Description of Unknown: Uncultured seed derived bacterium of the family Streptomycetaceae"
accttcgacagctccctccacaaggggttgggccaccggcttcgggtgttaccgactttcgtgacgtgacgggcggtgtgtacaaggcccgggaacgtattcaccgcagcaatgctgatctgcgattactagcaactccgacttcatggggtcgagttgcagaccccaatccgaactgagacaggctttttgagattcgctccacctcacggtatcgcagctcattgtacctgccattgtagcacgtgtgcagcccaagacataaggggcatgatgacttgacgtcgtccccaccttcctccgagttgaccccggcggtctcctgtgagtccccgtcaccccgaagggcacgctggcaacacaggacaagggttgcgctcgttgcgggacttaacccaa

SEQ ID NO: 1068 - DNA, 373 bp, Unknown
  source: /note="Description of Unknown: Uncultured seed derived bacterium of the family Comamonadaceae"
ctgccgtggtaatcgccctccttgcggttaggctaactacttctggcagaacccgctcccatggtgtgacgggcggtgtgtacaagacccgggaacgtattcaccgcgacattctgatccgcgattactagcgattccgacttcacgtagtcgagttgcagactacgatccggactacgactggttttatgggattagctccccctcgcgggttggcaaccctctgtaccagccattgtatgacgtgtgtagccctacctataagggccatgaggacttgacgtcatccccaccttcctccggttcgtcaccggcagtctcattagagtgcccaactaaatgtagcaactaatgacaagggttgcgctcgttg

SEQ ID NO: 1069 - DNA, 439 bp, Unknown
  source: /note="Description of Unknown: Uncultured seed derived bacterium of the family Sinobacteraceae"
gccgtggtaggcgccccccttgcggtcaggctacctgcttctggtgcaatcaactcccatggtgtgacgggcggtgtgtacaagacccgggaacgtattcaccgcagcaatgctgatctgcgattactagcgattccgacttcacggagtcgagttgcagactccgatccggactacgataagttttctgggattggctccgtctcgcgacttggcttccctctgtacttaccattgtagcacgtgtgtagccctggccataaaggccatgatgacttgacgtcatccccaccttcctccggtttgtcaccggcggtctccttagagtgcccaacttaatgctggcaactaaggacaagggttgcgctcgttgcgggacttaacccaacatctcacgacacgagctgacgacagccatgcagcacctgtgttcgagttc

SEQ ID NO: 1070 - DNA, 734 bp, Unknown
  source: /note="Description of Unknown: Uncultured seed derived bacterium"
aacaggattagataccctggtagtccacgccgtaaacgatgagtgctagatgtccggggtatcgacccccctggtgtcgcagctaacgcaataagcactccgcctggggagtacggccgcaaggttgaaactcaaaggaattgacgggggcccgcacaagtggtggagcatgtgcattaattcgtcactaaccgaagaaccttaccagggtttgacatcctctgacatcctgtgaaagcaggctttcctcgcaagaggacagagagacaggtgttgcatggttgtcgtcagctcgtgtcgtgagatgttgggttaagtcccgcaacgagcgcaaccctcacccaatgttgccagcgtcaagtcgggcactctttgggaactgcccgtgtaagcgggaggaaggtggggatgacgtcaaatcggcatggcccttacatcctgggcttgacacatgctacaatggccgttaaacagagcgacgcaataccgcgaggtggagccaatcgcaaaaatacggtctcagttcggattgcaggctgcaactcgcctgcatgaagtcggaatcgctagtaaccgcaggtcagctaaactgcggtgaatacgttcccgggccttgtacacactgcccgtcaagtcacctgagttgtctgcagccgaagccagtggcctaaccgcaagggaggagctgtctaagctgtggggagcgagggggactaagtcgtaacaaggtaacc

SEQ ID NO: 1071 - DNA, 436 bp, Unknown
  source: /note="Description of Unknown: Uncultured seed derived bacterium of the family Cytophagaceae"
taccgtggggaccgtcttccttgcggttaaactagccacttctggtaaaacccactcccatggcctgacgggcggtgtgtacaaggtccgggaacgtattcaccgcgccattgctgatgcgcgattactagcgattccaacttcatgcaggcgagttgcagcctgcaatccgaactgagacgtactttttgtgattggctcaccatcgctggcttgcaacactttgtatacgccattgtagcacgtgtgtagccctggacgtaagggccatgatgacctgacgtcatcccctccttcctctccgcttgcgcgggcagtttttctagagtccccatcattacatgccggcaactagaaacaggggttgcgctcgttgcgggacttaacccaacacctcacggcacgagctgacgacggccatgcagcaccttgctcc

SEQ ID NO: 1072 - DNA, 306 bp, Unknown
  source: /note="Description of Unknown: Uncultured seed derived bacterium of the family Burkholderiaceae"
  modified_base (205)..(205): a, c, t or g
tggggaccgtcttccttgcggttaaactagccacttctggtaaaacccactcccatggtgtgacgggcggtgtgtacaagacccgggaacgtattcaccgcggcatgctgttccgcgattactagcgattccagcttcgtgcagtcgagttgcagactgcaatccggactacgatcggctttctgggattggctcaccttcgcanggtcgctgccctctggaccgaccattgtatgacgtgtgaagccctacccgtaagggccatgaggacttgacgtcatccccaccttcctccggcttgtcacc

SEQ ID NO: 1073 - DNA, 449 bp, Unknown
  source: /note="Description of Unknown: Uncultured seed derived bacterium of the family Bradyrhizobiaceae"
taccgtggccggctgcctccattgctggttagcgcaccgtcttcaggtaaaaccaactcccatggtgtgacgggcggtgtgtacaaggcccgggaacgtattcaccgtggcgtgctgatccacgattactagcgattccaacttcatgggctcgagttgcagagcccaatccgaactgagacggctttttgagatttgctaggacttgcgtcttcgcatcccattgtcaccgccattgtagcacgtgtgtagcccagcccgtaagggccatgaggacttgacgtcatccccaccttcctcgcggcttatcaccggcagtctccttagagtgctcaactaaatggtagcaactaaggacgggggctgcgctcgttgcgggacttaacccaacatctcacgacacgagctgacgacagccatgcagcacctgtgttccaggctccgaagag

SEQ ID NO: 1074 - DNA, 317 bp, Unknown
  source: /note="Description of Unknown: Uncultured seed derived bacterium of the family Bacillaceae"
ccaccttaggcggctggctccaaaaaggttaccccaccgacttcgggtgttacaaactctcgtggtgtgacgggcggtgtgtacaaggcccgggaacgtattcaccgcggcatgctgatccgcgattactagcgattccagcttcatgtaggcgagttgcagcctacaatccgaactgagaacggttttatgagattagctccacctcgcggtcttgcagctctttgtaccgtccattgtagcacgtgtgtagcccaggtcataaggggcatgatgatttgacgtcatccccaccttcctccggtttgtcaccggca

SEQ ID NO: 1075 - DNA, 656 bp, Unknown
  source: /note="Description of Unknown: Uncultured seed derived bacterium of the family Anaeroplasmataceae"
aatcctaccctagtcaactacttcccttgcgggttagttaagttagttttaggcattactgactttcgtgatttgacgggcggtgtgtacaagacccgagaacgtattcaccgtgacactgctgattcacgattactagcaattccgacttcatggagtcgagttgcagactccaatccgaacttgggttagttttttgggattagctccccctcgcgggttggcgaccctttgtcctaaccattgtagcacgtgtgtagcccaaggcataagggccatgacgaccagacgtcatcctctccttcctccaagttgccttggcagtctacctagagttctcaccttaaatgtagtaactaagtatgagggttgcgttcgttctagcacttaagagtacacttcacagcacgaactgacgacggccatgcagcacctgtgtttggataacctctgctcggtttcccgagtcttgccaaacatgtcaagccttggtaaggttttacgcgttgtatcggattaaaccacatgctccagtgcttgtgcgggtccccgtcaattcctttgagtttcagcctcgcggccgtactacccaggcggagcatttaaagcgttaactgcgacactgagccaacgcccaatgtctaatgctcatcgtt

SEQ ID NO: 1076 - DNA, 534 bp, Unknown
  source: /note="Description of Unknown: Uncultured seed derived bacterium of the family Sphingomonadaceae"
accaccgtggtcgcctgcctcccttacgggttagcgcaacgccttcgggtgaatccaactcccatggtgtgacgggcggtgtgtacaaggcctgggaacgtattcaccgcggcatgctgatccgcgattactagcgattccgccttcatgctctcgagttgcagagaacaatccgaactgagacggcttttgggattagcatcctctcgcgaggtagcaacccgttgtcaccgccattgtagcacgtgtgtagcccagcgtgtaagggccatgaggacttgacgtcatccccaccttcctccggcttatcaccggcggtttctttagagtgcccaactaaatgatggcaactaaagacgagggttgcgctcgttgcgggacttaacccaacatctcacgacacgagctgacgacagccatgcagcacctgtcactcatccagccgaactgaaggaaatcatctctgaaatccgcgatgaggatgtcaaacgctggtaaggttctgcgcgttgcttcgaattaaaccacatgctc

SEQ ID NO: 1077 - DNA, 374 bp, Unknown
  source: /note="Description of Unknown: Uncultured seed derived bacterium of the family Pseudonocardiaceae"
  modified_base (10)..(10): a, c, t or g
accttcgacnctccctccccttacggggttgggccatgggcttcgggtgttaccgactttcatgacgtgacgggcggtgtgtacaaggcccgggaacgtattcaccgcagcgttgctgatctgcgattactagcgactccgacttcacgcagtcgagttgcagactgcgatccgaactgagaccggctttaagggattcgctccacctcgcggtatcgcagccctctgtaccagccattgtagcatgtgtgaagccctggacataaggggcatgatgacttgacgtcatccccaccttcctccgagttgaccccggcagtctcccacgagtccccgcataacgcgctggcaacgtaggataagggttgcgctcg

SEQ ID NO: 1078 - DNA, 429 bp, Unknown
  source: /note="Description of Unknown: Uncultured seed derived bacterium of the family Brucellaceae"
ccctaccgtggctagctgcctccttgcggttagcgcactaccttcgggtaaaaccaactcccatggtgtgacgggcggtgtgtacaaggcccgggaacgtattcaccgcggcatgctgatccgcgattactagcgattccaacttcatgcactcgagttgcagagtgcaatccgaactgagatggcttttggagattagctccacatcgctgtctcgctgcccactgtcaccaccattgtagcacgtgtgtagcccagcccgtaagggccatgaggacttgacgtcatccccaccttcctctcggcttatcaccggcagtccccttagagtgcccaactgaatgctggcaactaagggcgagggctgcgctcgttgcgggacttaacccaacatctcacgacacgagctgacgacagccatgcagcacc

SEQ ID NO: 1079 - DNA, 419 bp, Unknown
  source: /note="Description of Unknown: Uncultured seed derived bacterium of the family Phyllobacteriaceae"
tgaccctaccgtggtcgcctgcctccttgcggttagcacagcgccttcgggtaaaaccaactcccatggtgtgacgggcggtgtgtacaaggcccgggaacgtattcaccgcggcatgctgatccgcgattactagcgattccaacttcatgcactcgagttgcagagtgcaatccgaactgagatggcttttggagattagctcgacctcgcggtctcgctgcccactgtcaccaccattgtagcacgtgtgtagcccagcccgtaagggccatgaggacttgacgtcatccccaccttcctctcggcttatcaccggcagtccccttagagtgcccaacttaatgctggcaactaagggcgagggttgcgctcgttgcgggacttaacccaacatctcacgacacgagctgacgaca

SEQ ID NO: 1080 - DNA, 369 bp, Unknown
  source: /note="Description of Unknown: Uncultured seed derived bacterium of the family Burkholderiaceae"
atcctaccgtggtgaccgtcctccttgcggttagactagccacttctggtaaaacccactcccatggtgtgacgggcggtgtgtacaagacccgggaacgtattcaccgcggcatgctgatccgcgattactagcgattccagcttcacgcagtcgagttgcagactgcgatccggactacgatcggttttctgggattggctccacctcgcggcttggcaaccctctgttccgaccattgtatgacgtgtgaagccctacccataagggccatgaggacttgacgtcatccccaccttcctccggtttgtcaccggcagtccccctagagtgctcttgcgtagcaactagggacaagggttgcgctcg

SEQ ID NO: 1081 - DNA, 422 bp, Unknown
  source: /note="Description of Unknown: Uncultured seed derived bacterium of the family Rhodospirillaceae"
cctaccgtggtcggctgcttccttgcggttagcgcaccggcttcgggtagaaccaactcccatggtgtgacgggcggtgtgtacaaggcccgggaacgtattcaccgcggcatgctgatccgcgattactagcgattccaacttcatgcacccgagttgcagagtgcaatccgaactgagacggctttttgagatcggctcaggctcgcgcctttgctccccattgtcaccgccattgtagcacgtgtgtagcccaacccgtaagggccatgaggacttgacgtcatccccgccttcctccggcttgtcaccggcagtttcttcagagtgcccaactaaatgatggcaactgaagatgagggttgcgctcgttgcgggacttaacccaacatctcacgacacgagctgacgacagccatgca

SEQ ID NO: 1082 - DNA, 432 bp, Unknown
  source: /note="Description of Unknown: Uncultured seed derived bacterium of the family Sinobacteraceae"
  modified_base (307)..(307): a, c, t or g
accgtggtaagcgccctccttgcggtcaggctacctgcttctggtgcaatcaactcccatggtgtgacgggcggtgtgtacaagacccgggaacgtattcaccgcagcaatgctgatccgcgattactagcgattccaacttcatggagtcgagttgcagactccaatccggactaagacaagttttctgggattagctccccgtcgccggttggcttccctctgtacttgccattgtagcacgtgtgtagccctggccataaaggccatgatgacttgacgtcatccccaccttcctccggtttgncaccggcggtctccttagagttcccaactgaatgatggcaactaaggacaagggttgcgctcgttgcgggacttaacccaacatctcacgacacgagctgacgacagccatgcagcacctgtgtt

SEQ ID NO: 1083 - DNA, 459 bp, Unknown
  source: /note="Description of Unknown: Uncultured seed derived bacterium of the family Enterobacteriaceae"
ggtaagcgccctcccgaaggttaagctacctacttcttttgcaacccactcccatggtgtgacgggcggtgtgtacaaggcccgggaacgtattcaccgtagcattctgatctacgattactagcgattccgacttcacggagtcgagttgcagactccgatccggactacgacgcactttatgaggtccgcttgctctcgcgaggtcgcttctctttgtatgcgccattgtagcacgtgtgtagccctactcgtaagggccatgatgacttgacgtcatccccaccttcctccagtttatcactggcagtctcctttgagttcccggccgaaccgctggcaacagaggataagggttgcgctcgttgcgggacctaacccaacatttcacaacacgagctgacgacagccatgcagcacctgtctcagagttcccgaaggcaccaaagcatctctgct

SEQ ID NO: 1084 - DNA, 406 bp, Unknown
  source: /note="Description of Unknown: Uncultured seed derived bacterium of the family Xanthomonadaceae"
ctccgtggtcgtcgtcccccttgcggttagactaacggcttctggagcagctcactcccatggtgtgacgggcggtgtgtacaaggcccgggaacgtattcaccgcagcatagctgatctgcgattactagcgattccgacttcatggagtcgagttgcagactccaatccggactgggatcggctttctgggattagctccacctcgcggtatcgcaaccctctgtaccgaccattgtagtacgtgtgtagccctggccgtaagggccatgatgacttgacgtcatccccaccttcctccggtttgtcaccggcagtctccttagagttcccaccattacgtgctggcaactaaggacaagggttgcgctcgttgcgggacttaacccaacatctcacgacacga

SEQ ID NO: 1085 - DNA, 388 bp, Unknown
  source: /note="Description of Unknown: Uncultured seed derived bacterium of the family Sphingobacteriaceae"
  modified_base (350)..(350): a, c, t or g
ccctaggcggctccttgcggttaccgacttcaggcacccccagcttccatggcttgacgggcggtgtgtacaaggcccgggaacgtattcaccgcagcattgctgatcagcgattactagcgaatccaacttcatggggtcgagttgcagaccccaatccgaactgtgaatgactttgtgagattggcatcctgttgccaggtagctgccctctgtatcatccattgtagcacgtgtgtagccccggacgtaagggccatgatgacttgacgtcgtcccctccttcctctctatttgcataggcagtctgtttagagtccccaccattacatgctggcaactagacatangggttgcgctcgttgcgggacttaacccaacacctcac

SEQ ID NO: 1086 - DNA, 409 bp, Unknown
  source: /note="Description of Unknown: Uncultured seed derived bacterium"
gtaaccgccctcctttcggttaagctagctacttctggtgcaacagactcccatggtgtgacgggcggtgtgtacaaggcccgggaacgtattcaccgcagcatgctgatctgcgattactagcgattccgacttcatgcagtcgagttgcagactgcaatccggactacgaccggttttctcggattggctccccctcgcaggtttgcaaccgtttgtaccggccattgtagcacgtgtgtagcccgccccgtgagggccatgatgacttgacgtcgtccccaccttcctccggtttgtcaccggcagtctccttagagttcccgccattacgcgctggcaactaaggacaagggttgcgctcgttacgggacttaacccaacatctcacgacacgagctgacgacag

SEQ ID NO: 1087 - DNA, 497 bp, Unknown
  source: /note="Description of Unknown: Uncultured seed derived bacterium of the family Xanthobacteraceae"
taccgtggtcgcctgcctccttgcggttggcgcagcgccttcgggtaaaaccaactcccatggtgtgacgggcggtgtgtacaaggcccgggaacgtattcaccgtagcatgctgatctacgattactagcgattccaccttcatgcactcgagttgcagagtgcaatctgaactgagacggcttttggagatttgcgaggggtcgcccctttgcatcccactgtcaccgccattgtagcacgtgtgtagcccagcccgtaagggccatgaggacttgacgtcgtccccaccttcctcgcggcttatcaccggcagtccccctagagtgcccaacttaatgctggcaactaggggcgagggttgcgctcgttgcgggacttaacccaacatctcacgacacgagctgacgacagccatgcagcacctgtcaccggtccagcccgaactgaaggatctcatctctgtgatccgcgaccgggatgtcaagggctggtaa

SEQ ID NO: 1088 - DNA, 447 bp, Unknown
  source: /note="Description of Unknown: Uncultured seed derived bacterium"
acaactccgacggctatctcccttgcgggttaaatcaccggttttggttgcacccaactttcgtggtgtgacgggcggtgtgtacaaggcccgggaacgtattcaccggagccagctgatctccgattactagcgattccgccttcatgtgggcgaatttcagcccacaatctgaactggggccggcttttagagatttgctcctccttacggatttgctgctcgttgtaccggccattgtagcacgtgtgtagccctggacataaaggccatggtgacttgacgtcatccccaccttcctccccgttttccgaggcagttccctaagagtgctgtccattacagacgtggcaacatagggtaagggttgcgctcgttgcgggacttaacccaacatctcacgacacgagctgacgacagccatgcagcacctctgctagctactga

SEQ ID NO: 1089 - DNA, 439 bp, Unknown
  source: /note="Description of Unknown: Uncultured seed derived bacterium of the family Burkholderiaceae"
cctaccgtggggaccgtcttccttgcggttaaactagccacttctggtaaaacccactcccatggtgtgacgggcggtgtgtacaagacccgggaacgtattcaccgcggcatgctgttccgcgattactagcgattccagcttcatgcagtcgagttgcagactgcaatccggactacgatcggctttctgggattggctcaccttcgcagggtcgctgccctctggaccgaccattgtatgacgtgtgaagccctacccgtaagggccatgaggacttgacgtcatccccaccttcctccggcttgtcaccggcagtctccttagagtgccctcgcgtagcaaataaggataagggttgcgctcgttgcgggacttaacccaacatctcacgacacgagctgacgacagccatgcagcacctgtgtgttggctctct

SEQ ID NO: 1090 - DNA, 378 bp, Unknown
  source: /note="Description of Unknown: Uncultured seed derived bacterium of the family Enterobacteriaceae"
atcacaaagtggtaagcgccctcccgaaggttaagctacctacttcttttgcaacccactcccatggtgtgacgggcggtgtgtacaaggcccgggaacgtattcaccgtagcattctgatctacgattactagcgattccgacttcatggagtcgagttgcagactccaatccggactacgacgcactttatgaggtccgcttgctctcgcgaggtcgcttctctttgtatgcgccattgtagcacgtgtgtagccctactcgtaagggccatgatgacttgacgtcatccccaccttcctccagtttatcactggcagtctcctttgagttcccggcctaaccgctggcaacaaaggataagggttgcgctcgttg

SEQ ID NO: 1091 - DNA, 630 bp, Unknown
  source: /note="Description of Unknown: Uncultured seed derived bacterium of the family EB1017"
cggattccgtgccgtagctaacgtattaagtgccccgcctggggagtacggccgcaaggctaaaactcaaaggaattgacgggggcccgcacaagcggcggagcatgttgcttaattcgatgcaacgcgaagaaccttacctgggtttgacatgtagggaaaagccgtagagatacggtgtccttcggggccctacacaggtggtgcatggctgtcgtcagctcgtgtcgtgagatgttgggttaagtcccgcaacgagcgcaacccctatcctatgttgccagcgcgttatggcggggactcgtaggagactgccggtgccaaaccggaggaaggtggggatgaggtcaagtcatcatgccccttacgtccagggctgctaacatgctacaatggctggtacaaagggttgctacttcgcgagaagacgccaatcccaaaaagccagtctcagttcggattgcagtctgcaactcgactgcatgaagtcggagtcgctagtaatcgcagatcagcattgctgcggtgaatacgttcccgggccttgtacacaccgcccgtcacaccacgaaagttggtaacacccgaagccggtggcccaacccttgggagggagccgtcgaaggtggg

SEQ ID NO: 1092 - DNA, 429 bp, Unknown
  source: /note="Description of Unknown: Uncultured seed derived bacterium of the family Comamonadaceae"
gccgtggtaatcgccccccttgcggttaggctaactacttctggcagaacccgctcccatggtgtgacgggcggtgtgtacaagacccgggaacgtattcaccgcggcaagctgatccgcgattactagcgattccgacttcacgcagtcgagttgcagactgcgatccggactacgaccgggtttctgggattagctccccctcgcgggttggcagccctctgtcccggccattgtatgacgtgtgtagccctacccataagggccatgatgacctgacgtcatccccaccttcctccggtttgtcaccggcagtctcattagagtgccctttcgtagcaactaatgacaagggttgcgctcgttgcgggacttaacccaacatctcacgacacgagctgacgacggccatgcagcacctgtgtccag

SEQ ID NO: 1093 - DNA, 443 bp, Unknown
  source: /note="Description of Unknown: Uncultured seed derived bacterium of the family Rhizobiaceae"
ctaccgtggtcgcctgcccccttgcggttagcgcagcgccttcgggtaaaaccaactcccatggtgtgacgggcggtgtgtacaaggcccgggaacgtattcaccgcggcgttctgatccgcgattactagcgattccaacttcatgcactcgagttgcagagtgcaatccgaactgagatggcttttggagattagctcggggtcgccccttcgctgcccactgtcaccaccattgtagcacgtgtgtagcccagcccgtaagggccatgaggacttgacgtcatccccaccttcctctcggcttatcaccggcagtccccttagagtgcccaactgaatgctggcaactaagggcgagggttgcgctcgttgcgggacttaacccaacatctcacgacacgagctgacgacagccatgcagcacctgtctctacgccaccg

SEQ ID NO: 1094 - DNA, 408 bp, Unknown
  source: /note="Description of Unknown: Uncultured seed derived bacterium of the family Oxalobacteraceae"
  modified_base (64)..(64): a, c, t or g
tggcagaacccgctcccatggtgtgacgggcggtgtgtacaagacccgggaacgtattcaccgngacatgctgatccgcgattactagcgattccaacttcatgtagtcgagttgcagactacaatccggactacgatacactttctgggattagctccccctcgcgggttggcggccctctgtatgtaccattgtatgacgtgtgaagccctacccataagggccatgaggacttgacgtcatccccaccttcctccggtttgtcaccggcagtctcattagagtgccctttcgtagcaactaatgacaagggttgcgctcgttgcgggacttaacccaacatctcacgacacgagctgacgacagccatgcagcacctgtgttacggttctctttcgagcactccc

SEQ ID NO: 1095 - DNA, 492 bp, Unknown
  source: /note="Description of Unknown: Uncultured seed derived bacterium"
tctgcctccttgcggttagcgaaatgccttcgggtaaagccaactcccatggtgtgacgggcggtgtgtacaaggcccgggaacgtattcaccgcagcgttctgatccgcgattactagcgattccaccttcatgcacccgagttgcagagtgcaatccgaactgagacggctttttgagatttgccagggctcgcgccttcgcatcccactgtcaccgccattgtagcacgtgtgtagcccagcctgtaagggccatgaggacttgacgtcatccccaccttcctccggcttatcaccggcagtccctctagagtgcccaactaaatgatggcaactaaaggcgagggttgcgctcgttgcgggacttaacccaacatctcacgacacgagctgacgacagccatgcagcacctgtctctatgccaccgaagtggaaggtaaatctctctaccggtcataggatgtcaagggccggtaaggttctgcgcgt

SEQ ID NO: 1096 - DNA, 479 bp, Unknown
  source: /note="Description of Unknown: Uncultured seed derived bacterium"
ccaccttcgccggaggcctccttgcggttagcctgaccgtcttctggttgagtcagctcccatggtgtgacgggcggtgtgtacaaggcccgggaacgtattcaccgcggcgtgctgatccgcgattactagcgattccaacttcatggagtcgagttgcagactccaatccgaactgagaacggctttttgagattagctccgtgttaccacttggcgtccctctgtaccgtccattgtatcacgtgtgtcgccctggatataaaggccatgaggacttgacgtcatccccaccttcctccgtgttaaccacggcagtctctttagagagcccaactgaatgctggcaactaaagacaagggttgcgctcgttgcgggacttaacccaacatgtcaccacacgagctgacgacagccatgcagcacctgtcactctgtagtattgctactaaagccctatctctagggttgtcagagg

SEQ ID NO: 1097 - DNA, 643 bp, Unknown
  source: /note="Description of Unknown: Uncultured seed derived bacterium of the family Cytophagaceae"
ctcgctgttggcgatacacagccagcggctaagcgcaagcgataagtaatccacctggggagtacgccggcaacggtgaaactcaaaggaattgacgggggtccgcacaagcggtggagcatgtggtttaattcgatgatacgcgaggaaccttacctgggctagaatgcctatgaccgatccagagatggataattccgcaaggacagagagcaaggtgctgcatggccgtcgtcagctcgtgccgtgaggtgttgggttaagtcccgcaacgagcgcaacccctgtttctagttgccagcacgtcaaggtggggactctagaaaaactgcccgcgcaagcggagaggaaggaggggatgacgtcaggtcatcatggcccttacgcccagggctacacacgtgctacaatggtgcctacagagtgttgcaagccagcgatggtgagccaatcacaaaaagggcatctcagttcggattgcaggctgcaactcgcctgcatgaagttggaatcgctagtaatcgcgcatcagcaatggcgcggtgtatacgttcccggaccttgtacacaccgcccgtcaagcgatggaagttgggaggacctgaagacagttgttgtaagacgctgtttagggttaaaccga

SEQ ID NO: 1098 - DNA, 459 bp, Unknown
  source: /note="Description of Unknown: Uncultured seed derived bacterium of the family Comamonadaceae"
cctgccgtggtaatcaccctccttgcggttaagctaactacttctggcagaacccgctcccatggtgtgacgggcggtgtgtacaagacccgggaacgtattcaccgtgacattctgatccacgattactagcgattccgacttcacgcagtcgagttgcagactgcgatccggactacgactggttttatgggattagctccccctcgcgggttggcaaccctttgtaccagccattgtatgacgtgtgtagccccacctataagggccatgaggacttgacgtcatccccaccttcctccggtttgtcaccggcagtctcattagagtgcccaactgaatgtagcaactaatgacaagggttgcgctcgttgcgggacttaacccaacatctcacgacacgagctgacgacagccatgcggcacctgtgttacggttctctttcgaacactaagcca

SEQ ID NO: 1099 - DNA, 412 bp, Unknown
  source: /note="Description of Unknown: Uncultured seed derived bacterium of the family Oxalobacteraceae"
taccgtggtaagcgccctccttacggttaagctacctacttctggtaaaacccgctcccatggtgtgacgggcggtgtgtacaagaccctggaacgtattcaccgcgacatgctgatccgcgattactagcgattccaacttcatgtagtcgagttgcagactacaatccggactacgatacactttctgggattagctccccctcgcgggttggcggccctctgtatgtaccattgtatgacgtgtgaagccctacccataagggccatgaggacttgacgtcatccccaccttcctccggtttgtcaccggcagtctcattagagtgccctttcgtagcaactaatgacaagggttgcgctcgttgcgggacttaacccaacatctcacgacacgagctgacgacagcca

SEQ ID NO: 1100 - DNA, 420 bp, Unknown
  source: /note="Description of Unknown: Uncultured seed derived bacterium of the family Oxalobacteraceae"
atcctaccgtggtgagcgccctccttgcggttaggctacccacttctggcaaaacccgctcccatggtgtgacgggcggtgtgtacaagacccgggatcgtattcaccgcgacacgctgatccgcgattactagcgattccaacttcatggagtcgagttgcagactccaatccggactacgatacactttctgggattagctccccctcgcgggttggcggccctctgtatgtaccattgtatgacgtgtgaagccctacccataagggccatgaggacttgacgtcatccccaccttcctccggtttgtcaccggcagtctcattagagtgccctttcgtagcaactaatgacaagggttgcgctcgttgcgggacttaacccaacatctcacgacacgagctgacgacagccatgca

SEQ ID NO: 1101 - DNA, 390 bp, Unknown
  source: /note="Description of Unknown: Uncultured seed derived bacterium of the family Cytophagaceae"
tttaaccctaaacagcgccttacagcaactggcttcaggtcctcccaactcccatggcttgacgggcggtgtgtacaaggtccgggaacgtattcaccgcaacattgctgatttgcaattactagcgattccaacttcatgcaggcgagttgcagcctgcaatccgaactgagacgtactttttgtgattggctccctgtcaccaggtcgcaacactttgtatacgccattgtagcacgtgtgtagccctggacgtaagggccatgatgacttgacgtcgtcccctccttcctctctgcttgcgcaggcagtctttttagagtccccaccattacgtgctggcaactaaaaataggggttgcgctcgttgcgggacttaacccaacacct

SEQ ID NO: 1102 - DNA, 441 bp, Unknown
  source: /note="Description of Unknown: Uncultured seed derived bacterium of the family Caulobacteraceae"
taccgtggtcgcctgcctctcttgcgagttagcgcagcgccttcgggtaaagccaactcccatggtgtgacgggcggtgtgtacaaggcccgggaacgtattcaccgcggcatgctgatccgcgattactagcgattccaacttcatgcactcgagttgcggagtgcaatccgagctgagacgacttttagggattggctccccctcgcgggattgcagccctctgtagtcgccattgtagcacgtgtgtagcccaccttgtaagggccatgaggacttgacgtcatccccaccttcctccgaattaacttcggcagtactattagagtgcccagccaaacctgatggcaactaatagcgagggttgcgctcgttgcgggacttaacccaacatctcacgacacgagctgacgacagccatgcagcacctgtgtcccagtc

SEQ ID NO: 1103 - DNA, 378 bp, Unknown
  source: /note="Description of Unknown: Uncultured seed derived bacterium of the family Sphingomonadaceae"
aaccaccgtggtcgcctgcctctcttgcgagttagcgcaacgccttcgggtgaatccaactcccatggtgtgacgggcggtgtgtacaaggcctgggaacgtattcaccgcggcatgctgatccgcgattactagcgattccgccttcatgtactcgagttgcagagtacaatccgaactgagacaacttttggagattagctcaccctcgcaggattgctgcccactgtagttgccattgtagcacgtgtgtagcccagcgcgtaagggccatgaggacttgacgtcatccccaccttcctccggcttatcaccggcggttcctttagagtacccaactaaatgatggtaactaaaggcgagggttgcgctcgtcgc

SEQ ID NO: 1104 - DNA, 449 bp, Unknown
  source: /note="Description of Unknown: Uncultured seed derived bacterium of the family Burkholderiaceae"
  modified_base (107)..(107): a, c, t or g
ccgcggtcatcgccctccttgcggttaggctaaaggcttctggtagaaaccactcccatggtgtgacgggcggtgtgtacaagacccgggaacgtattcaccgcggnatgctgatccgcgattactagcgattccagcttcatgcagtcgagttgcagactgcaatccggactacgatccgttttctgggtttagcaccccctcgcaggttagcgtccctctgtacagaccattgtatgacgtgtgaagccctacccgtaagggccatgaggacttgacatcatccccaccttcctccggcttgtcaccggcagtctccttagagtgcccttgcgtagcaactaaggacaagggttgcgctcgttgcgggacttaacccaacatctcacgacacgagctgacgacagccatgcagcacctgtgcgccggttctcttgcgagcactcccg

SEQ ID NO: 1105 - DNA, 377 bp, Unknown
  source: /note="Description of Unknown: Uncultured seed derived bacterium of the family Rhodospirillaceae"
accctaccgtggtcggctgcctccttgcggttagcgcaccggcttcgggtaaagccaactcccatggtgtgacgggcggtgtgtacaaggcccgggaacgtattcaccgcagcatgctgatctgcgattactagcgattccgccttcatgcactcgagttgcagagtacaatccgaactgaggtggcttttggagatttgcttgacctcgcggtcttgcttcccactgtcaccaccattgtagcacgtgtgtagcccagcccataagggccatgaggacttgacgtcatccccgccttcctccggcttgtcaccggcggtttcgttagagtgcccagcctgactgatggcaactaacgatgagggttgcgctcgttg

SEQ ID NO: 1106 - DNA, 449 bp, Unknown
  source: /note="Description of Unknown: Uncultured seed derived bacterium of the family Burkholderiaceae"
agcgccctccttgcggttaggctacctacttctggtgaaacccactcccatggtgtgacgggcggtgtgtacatgacccgggaacgtattcaccgcggcatgctgatccgcgattactagcgattccagcttcacgcagtcgagttgcagactgcgatccggactacgatcggttttctgggattggctccacctcgcggcttggcaaccctctgttccgaccattgtatgacgtgtgaagccctacccataagggccatgaggacttgacgtcatccccaccttcctccggtttgtcaccggcagtctccttagagtgctcttgcgtagcaactaaggacaagggttgcgctcgttgcgggacttaacccaacatctcacgacacgagctgacgacagccatgcagcacctgtgcgccggttctctttcgagcactcccgcctctcag

SEQ ID NO: 1107 - DNA, 479 bp, Unknown
  source: /note="Description of Unknown: Uncultured seed derived bacterium of the family Rhizobiaceae"
accctaccgtggttagctgcctccttgcggttagcgcactaccttcgggtaaaaccaactcccatggtgtgacgggcggtgtgtacaaggcccgggaacgtattcaccgcggcatgctgatccgcgattactagcgattccaacttcatgcactcgagttgcagagtgcaatccgaactgagatggcttttggagattagctcggcctcgcggcctcgctgcccactgtcaccaccattgtagcacgtgtgtagcccagcccgtaagggccatgaggacttgacgtcatccccaccttcctctcggcttatcaccggcagtccccttagagtgcccaactgaatgctggcaactaagggcgagggttgcgctcgttgcgggacttaacccaacatctcacgacacgagctgacgacagccatgcagcacctgtctctacgccaccgaagtggaaactgcatctctgcaacggtcgtaag

SEQ ID NO: 1108 - DNA, 616 bp, Unknown
  source: /note="Description of Unknown: Uncultured seed derived bacterium of the family Caulobacteraceae"
taccgtggtcgcctgcctccttgcggttagcacagcgccttcgggtaaagccaactcccatggtgtgacgggcggtgtgtacaaggcccgggaacgtactcaccgcggcatgctgatccgcgattactagcgattccgacttcatgcactcgagttgcagagtgcaatccgaactgagacgacttttagggattggctctccatcgctggtttgcagccctctgtagtcgccattgtagcacgtgtgtagcccaccctgtaagggccatgaggacttgacgtcatccccaccttcctccggcttaccaccggcggtccctttagagtgcccaactatatgatggcaactaaaggcgagggttgcgctcgttgcgggacttaacccaacatctcacggcacgagctgacgacagccatgcagcacctgtgtcctcgtccccgaagggaactccagatctctctggatagcgaggcatgtcaaaaggtggtaaggttctgcgcgttgcttcgaattaaaccacatgctccaccgcttgtgcgggcccccgtcaattcctttgagttttaatcttgcgaccgtacaccccaggcggagtgcttaatgcgttagctgcgt

SEQ ID NO: 1109 - DNA, 441 bp, Unknown
  source: /note="Description of Unknown: Uncultured seed derived bacterium"
cgtggtcgcctgcctccttgcggttagcgcgacgccttcgggtaaacccaactcccatggtgtgacgggcggtgtgtacaaggcccgggaacgtattcaccgtggcatgctgatccacgattactagcgattccaccttcatgcacccgagttgcagagtgcaatctgaactgagacggctttttgggattagctcgaggtcgccctttcgctgcccattgtcaccgccattgtagcacgtgtgtagcccagcctgtaagggccatgaggacttgacgtcatccccaccttcctcgcggcttatcaccggcagtcccctagagttcccaactgaatgatggcaactaggggcgagggttgcgctcgttgcgggacttaacccaacatctcacgacacgagctgacgacagccatgcagcacctgtgttccggccagccgaa

SEQ ID NO: 1110 - DNA, 434 bp, Unknown
  source: /note="Description of Unknown: Uncultured seed derived bacterium of the family Rhizobiaceae"
taccgtggtcgcctgcccccttgtggttagcgcagcgccttcgggtaaaaccaactcccatggtgtgacgggcggtgtgtacaaggcccgggaacgtattcaccgcggcgctctgatccgcgattactagcgattccaacttcatgcactcgagttgcagagtgcaatccgaactgagatggcttttggagattagctcggggtcgccccttcgctgcccactgtcaccaccattgtagcacgtgtgtagcccagcccgtaagggccatgaggacttgacgtcatccccaccttcctctcggcttatcaccggcagtccccttagagtgcccaactgaatgctggcaactaagggcgagggttgcgctcgttgcgggacttaacccaacatctcacgacacgacctgacgacagccatgcagcacctgtctcta

SEQ ID NO: 1111 - DNA, 401 bp, Unknown
  source: /note="Description of Unknown: Uncultured seed derived bacterium of the family Comamonadaceae"
cgtggtaagcgccctccttgcggttaggctacctacttctggcgagacccgctcccatggtgtgacgggcggtgtgtacaagacccgggaacgtattcaccgtgacattctgatccacgattactagcgattccgacttcacgcagtcgagttgcagactgcgatccggactacgtctggctttatgggattagctccccctcgcgggttggcaaccctttgtaccagccattgtatgacgtgtgtagccccacctataagggccatgaggacttgacgtcatccccaccttcctccggtttgtcaccggcagtcccattagagtgccctttcgtagcaactaatggcaagggttgcgctcgttgcgggacttaacccaacatctcacgacacgagctgac

SEQ ID NO: 1112 - DNA, 501 bp, Unknown
  source: /note="Description of Unknown: Uncultured seed derived bacterium of the family Xanthobacteraceae"
taccgtggtcgcctgcctccttgcggttggcgcagcgccttcgggtaaaaccaactccatggtgtgacgggcggtgtgtacaaggcccgggaacgtattcaccgcagcatgctgatctgcgattactagcgattccaccttcatgcactcgagttgcagagtgcaatctgaactgagacggcttttggagatttgctaggggtcaccccttcgcttcccactgtcaccgccattgtagcacgtgtgtagcccagcccgtaagggccatgaggacttgacgtcatccccaccttcctcgcggcttatcaccggcagtccccctagagtgcccaactcaatgctggcaactaggggcgagggttgcgctcgttgcgggacttaacccaacatctcacgacacgagctgacgacagccatgcagcacctgtctccggtccagccgaactgaaggatctcatctctgtgatccgcgaccggratgtcaagggctggtaaggttct

SEQ ID NO: 1113 - DNA, 439 bp, Unknown
  source: /note="Description of Unknown: Uncultured seed derived bacterium of the family Caulobacteraceae"
ctaccgtggtcggctgcctccattgctggttagcgcaccgccttcgggtaaagccaactcccatgatgtgacgggcggtgtgtacaaggcccgggaacgtattcaccgcggcatgctgatccgcgattactagcgattccgacttcatgcactcgagttgcagagtgcaatccgaactgagacgacttttggggattagctcaccttcgcagggttgcaaccctctgtagtcgccattgtagcacgtgtgtagcgcaccttgtaagggccatgaggacttgacgtcatccccaccttcctccggcttaccaccggcggtcccattagagtgcccaacttaatgatggcaactaatggcgagagttgcgctcgttgcgggacttaacccaacatctcacgacacgagctgacgacagccatgcagcacctgtgtcccagt

SEQ ID NO: 1114 - DNA, 466 bp, Unknown
  source: /note="Description of Unknown: Uncultured seed derived bacterium of the family Rhizobiaceae"
ggtcgcctgcccccttgcggttagcgcagcgccttcgggtaaaaccaactcccatggtgtgacgggcggtgtgtacaaggcccggggacgtattcaccgcagcatgctgatctgcgattactagcgattccaacttcatgcactcgagttgcagagtgcaatccgaactgagatggcttttggagattagctcgacatcgctgtctcgctgcccactgtcaccaccattgtagcacgtgtgtagcccagcccgtaagggccatgaggacttgacgtcatccccaccttcctctcggcttatcaccggcagtccccttagagtgcccaactaaatgctggcaactaagggcgagggttgcgctcgttgcgggacttaacccaacatctcacgacacgagctgacgacagccatgcagcacctgttctagggcagccgaactgaaggtcatcgtctccaatgaccata

SEQ ID NO: 1115 - DNA, 509 bp, Unknown
  source: /note="Description of Unknown: Uncultured seed derived bacterium of the family Rhizobiaceae"
acccggttagctgcctccttgcggttagcgcactaccttcgggtaaaaccaactcccatggtgtgacgggcggtgtgtacaaggcccgggaacgtattcaccgcggcatgctgatccgcgattactagcgattccaacttcatgcactcgagttgcagagtgcaatccgaactgagatggcttttggagattagctcgacatcgctgtctcgctgcccactgtcaccaccatcgtagcacgtgtgtagcccagcccgtaagggccatgaggacttgacgtcatccccaccttcctctcggcttatcaccggcagtccccttagagtgcccaactaaatgctggcaactaagggcgagggttgcgctcgttgcgggacttaacccaacatctcacgacacgagctgacgacagccatgcagcacctgtgtcccggtccccgaagggagccttgcatctctgcaagtagccgggcatgtcaagggctggtaaggttctgcgcgttgcttcg

SEQ ID NO: 1116 - DNA, 429 bp, Unknown
  source: /note="Description of Unknown: Uncultured seed derived bacterium of the family Caulobacteraceae"
ggtcgcctgcctccttgcggttaacacagcgccttcgggtaaagccaactcccatggtgtgacgggcggtgtgtacacggcccgggaacgtattcaccgcggcatgctgatccgcgattactagcgattccgacttcatgcactcgagttgcagagtgcaatccgaactgagacgacttttagggattggctctccaccgctggtttgcagccctctgtagtcgccattgtagcacgtgtgtagcccaccctgtaagggccatgaggacttgacgtcatccccaccttcctccggcttaccaccggcggtccctttagagtgcccaacttaatgatggcaactaaaggcgagggttgcgctcgttgcgggacttaacccaacatctcacgacacgagctgacgacagccatgcagcacctgtgtcctcg

SEQ ID NO: 1117 - DNA, 449 bp, Unknown
  source: /note="Description of Unknown: Uncultured seed derived bacterium of the family Comamonadaceae"
gtaatcgccctcctagcggttaggctaactacttctggcagaacccgctcccatggtgtaacgggcggtgtgtacaagacccgggaacgtattcaccgcggcaagctgatccgcgattactagcgattccgacttcacgcagtcgagttgcagactacgatccggactacgaccgggtttctgggattagctccccctcgcgggttggcagccctctgtcccggccattgtgtgacgtgtgtagccctacccataagggccatgatgacctgacgtcatccccaccttcctccggtttgtcaccggcagtctcattagagtgccctttcgtagcaactaatgacaagggttgcgctcgttgcgggacttaacccaacatctcacgacacgagttgacgacggccatgcagcacctgtgttctggctctctttcgagcactcccaagtct

SEQ ID NO: 1118 - DNA, 434 bp, Unknown
  source: /note="Description of Unknown: Uncultured seed derived bacterium of the family Comamonadaceae"
tggtaagcgccctccttgcggctaggctaccaacttctggcgagacccgctcccatggtgtgacgggcggtgtgtacaagacccgggaacgtattcaccgtgacattctgatccacgattactagcgattccgacttcacgcagtcgagttgcagactgcgatccggactacgactggctttatgggattagctacccctcgcgggttggcaaccctttgtaccagccattgtatgacgtgtgtagccccacctataagggccatgaggacttgacgtcatccccaccttcctccggtttgtcaccggcagtcccattagagtgccctttcgtagcaactaatggcaagggttgcgctcgttgcgggacttaacccaacatctcacgacacgagctgacgacagccatgcagcacctgtgtgcaggttctcttt

SEQ ID NO: 1119 - DNA, 491 bp, Unknown
  source: /note="Description of Unknown: Uncultured seed derived bacterium of the family Comamonadaceae"
tgccgtggtaatcgccctccttgcggttaggctaactacttctggcagaacccgctcccatggtgtgacgggcggtgtgtacaagacccgggaacgtattcaccgcagcaagctgatccgcgattactagcgattccgacttcacgcagtcgagttgcagactacgatccggactacgaccgggcttctgggattagctccccctcgcgggttggcagccctctgtcccggccattgtatgacgtgtgtagccctacccataagggccatgatgacctgacgtcatccccaccttcctccggtttgtcaccggcagtctcattagagtgccctttcgtagcaactaatgacaagggttgcgctcgttgcgggacttaacccaacatctcacgacacgagctgacgacggccatgcagcacctgtgttctggctctctttcgagcactcccaaatcttttcaggattccagacatgtcaagggtaggtaagg

SEQ ID NO: 1120 - DNA, 449 bp, Unknown
  source: /note="Description of Unknown: Uncultured seed derived bacterium of the family Rhizobiaceae"
ctaccgtggttagctgcctccttgcggttagcgcactaccttcgggtaaaaccaactcccatggtgtgacgggcggtgtgtacaaggcccgggaacgtattcaccgcggcgtgctgatccgcgattactagcgattccaacttcatgcactcgagttgcagagtgcaatccgaactgagatggcttttggagattagctcacgctcgcgcgctcgctgcccactgtcaccaccattgtagcacgtgtgtagcctagcccgtaagggccatgaggacttgacgtcatccccaccttcctctcggcttatcaccggcagtccccttagagtgcccaactgaatgctggcaactaagggcgagggttgcgctcgttgcgggacttaacccaacatctcacgacacgagctgacgacagccatgcagcacctgtctccggtccagccgaactg

SEQ ID NO: 1121 - DNA, 821 bp, Unknown
  source: /note="Description of Unknown: Uncultured seed derived archaeon of the family SAGMA X"
ttccggttgatcctgccggacctgactgctatcggattggtactaagccatgcgagtcattgtagcaatacaaggcggacggctcagtaacacgtagtcaacctaactcgtggacgtggataacctcgggaaactgagaacaaaccacgatagaccatagtgcctggaatggcttatggtccaaacagtttactgccatgggatgggactgcggcctatcagcttgttggtggggtaatggcccaccaaggcgattacaggtacgggctctgagaggagaagcccggagatgggtactgagacacggacccaggccctatggggcgcagcaggcgagaaaccttagcaatgtgcgaaggcacgactgggtcagcccgagtgattcctgataaaggagtcttttgcttgtcctaaaagcacaggtgaataaggggtgggcaagtctggtgtcagccgccgcggtaataccagcacctcgagtggtcaggacgtttattgggcctaaagcatccgtagccggctttgcaagtcttcggttaaatccacctgctcaacagatgggctgctggggatactacaaagctagggagtgggagaggcagacggtattcagtgggtaggggtaaaatcctctgatccattgaggaccaccagtggcgaaggcggtctgccagaacacgttcgacggtgagggatgaaagctgggggagcaaaccggattagatacccgggtagtcccagctgtaaacgatgcaaactcggtgatgcattggcttatggccaatgcagtgccgcagggaaaccgttaagtttgccgcctg

SEQ ID NO: 1122 - DNA, 760 bp, Unknown
  source: /note="Description of Unknown: Uncultured seed derived archaeon of the family DHVEG 1"
aacaacctctctccggcaccgagtgcccgcgtaggactcccgacaccaagaccgcagcgtttacaccctggactacccgggtatctaatccggtttgcgccccagggcttcgtccctcaccgtcggagccgttctatcacgacgccttcgccaccggtagtcccccgaggattacagaatttcacctctacccccggagtacttcgtgactctcccggtcccaagctgagcggtctacccgcggttcgaacggttaagccgttcgatttacacaggcatctactcagccggctacggacgttttaggcccaataataacggccaccactcgggctgcaggtattaccgcggcggctggcacccgtcttacccagcccttacttcctatgttttttagacaatggaacagtcggcacttagtgccggcacttggagttcccgcatcgctgtttccagcattgtgcagttttcgcgcctgctgcgccccgtagggcctgaactcgtgtcttagagttcatctccgggcgacgtctctcaacgcccgtacccgtcgtaggctagggaggccgttaccctccctacaacctgataggtcgcagtgcatcctaaggctccggagatttcgtccaggagtcattccagatctcttgggctatggggtattagcctcagtttcccgagattattccccaccttagggcaggttcaccacgtgttactgagcggtctgccgagggccgaaccctctcgactcgcaggc

SEQ ID NO: 1123 - DNA, 777 bp, Unknown
  source: /note="Description of Unknown: Uncultured seed derived archaeon of the family SAGMA X"
aggcggcaaacttaacggcttccctgcggcactgcattggccataagccaatgcatcaccgagtttgcatcgtttacagctgggactacccgggtatctaatccggtttgctcccccagctttcatccctcaccgtcgaacgtgttctggcagaccgccttcgccactggtggtcctcaatggatcagaggattttacccctaccctctgaataccgtctgcctctcccactccctagctttgtagtatctccagcagcccatctgttgagcaggtggatttaaccgaagacttgcaaagccggctacggatgctttaagcccaataaacgtcctgaccactcgaggtgctggtatcaccgcggcggctgacaccagacttgcccaccccttattcacctgtgcttttaggacaagcaaaagactcctttatcaggaatcactcggactgacccagtcgtgctttcgcacattgctaaggtttctcgcctgctgcgccccatagggcctgggtccgtgtctcagtacccatctccgggcttctcctctcagagcccgtacctgtaatcgccttggtgggccattacctcaccaacaagctgataggccgcagtcccatcccatggcagtaaactgtttggaccataagccattccaggcactatggtctatcgtggtttattctcagtttcccgaggttatccacgtccacgagttaggttgactacgtgttactgagccgtccgccttgtattgctacaatgactcgcatggctta

SEQ ID NO: 1124 - DNA, 762 bp, Unknown
  source: /note="Description of Unknown: Uncultured seed derived archaeon of the family SAGMA X"
aaacttaacggcttccctgcggcactgcattggccataagccaatgcatcaccgagtttgcatcgtttacagctgggactacccgggtatctaatccggtttgctcccccagctttcatccctcaccgtcgaacgtgttctggcagaccgccttcgccactggtggtcctcaatggatcagaggattttacccctacccactgaataccgtctgcctctcccactccctagctttgtagtatctccagcagcccatctgttgagcaggtggatttaaccgaagacttgcaaagccggctacggatgctttaggcccaataaacgtcctgaccactcgaggcgctggtattaccgcggcggctgacaccagacttgcccaccccttattcacctgtgcttttaggacaggcaaaagactcctttatcaggaatcactcggactgacccagtcgtgctttcgcatattgctaaggtttctcgcctgctgcgccccatagggcctgggtccgtgtctcagtacccatctccgggcttctcctctcagagcccgtacctgtaatcgccttggtgggccattacctcaccaacaagctgataggccgcagtcccatcccatggcagtaaactgtttggaccataagccgttccaggccctatggtctatcgtggtttattctcagtttcccgaggttatccacgtccacgagttaggttgactacgtgttaccgagccgtccgccttgtattgctacaatgactcgc

SEQ ID NO: 1125 - DNA, 823 bp, Unknown
  source: /note="Description of Unknown: Uncultured seed derived archaeon of the family SAGMA X"
ttccggttgatcctgccggacctgactgctatcggattggtactaagccatgcgagtcattgtagcaatacaaggcggacggctcagtaacacgtagtcaacctaactcgtggacgtggataacctcgggaaactgagaataaaccacgatagaccatagtgcctggaatggcttatggtccaaacagtttactgccatgggatgggactgcggcctatcagcttgttggagaggtaatggcccaccaaggcgattacaggtacgggctctgagaggagaagcccggagatgggtactgagacacggacccaggccctatggggcgcagcaggcgagaaaccttagcaatgtgcgaaagcacgactgggtcagttcgagtgattcctgataaaggagtcttttgcttgtcctaaaagcacaggtgaataaggggtgggcaagtctggtgtcagccgccgcggtaataccagcacctcgagtggtcaggacgtttattgggcctaaagcatccgtagccggctttgcaagtcttcggttaaatccacctgctcaacagatgggccgctggaggtactacaaagctagggagtgggagaggcagacggtattcagtgggtaggggtaaaatcctctgatccattgaggactaccagtggcgaaggcggtctgccagaacacgttcgacggtgagggatgaaagctgggggagcaaaccggattagatacccgggtagtcccaactgtaaacgatgctaactcggtgatgcattggcttatggccaatgcagtgccgcagggaagccgttaagtttgccgcctgga

SEQ ID NO: 1126 - DNA, 777 bp, Unknown
  source: /note="Description of Unknown: Uncultured seed derived archaeon of the family SAGMA X"
aggcggtaaacttaacggctcccctgcggcactgcattggccataagccaatgcatcactgagtttgcatcgtttacagctgggactacccgggtatctaatccggtttgctcccccagctttcatccctcaccgtcgaacgtgttctggcagaccgccttcgccactggtggtcctcaatggatcagaggattttacccctacccactgaataccgtctgcctctcccactccctagctttgtagtatctccagcagcccatctgttgagcaggtggatttaaccgaagacttgcaaagccggctacggatgctttaggcccaataaacgtcctgaccactcgaggtgctggtattaccgcggcggctgacaccagacttgcccaccccttattcacctgtgcttttaggacaagcaaaagactcctttgtcaggaatcactcggactgacccagtcgtgctttcgcacattgctaaggtttctcgcctgctgcgccccataggcctgggtccgtgtctcagtacccatctccgggcttctcctctcagagcccgtacctgtaatcgccttggtgggccattacctcaccaacaagctgataggccgcagtcccatcccatggcagtaaactgtttggaccataagccattccaggcactatggtctatcgtggtttattctcagtttcccgatgttatccacgtccacgagttaggttgactacgtgttactgagccgtccgccttgtattgctacaatgactcgcatggcctag

SEQ ID NO: 1127 - DNA, 661 bp, Unknown; identical to SEQ ID NO: 995
  source: /note="Description of Unknown: Uncultured seed derived bacterium of the family Enterobacteriaceae"

SEQ ID NO: 1128 - DNA, 1453 bp, Unknown
  source: /note="Description of Unknown: Uncultured seed derived bacterium of the family Enterobacteriaceae"
cggcaggcctaacacatgcaagtcgaacggtagcacagagagcttgctcttgggtgacgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcgaggaggaaggcattgtggttaataaccgcagtgattgacgttactcgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcatatacaaagagaagcgacctcgcgagagcaagcggacctcataaagtatgtcgtagtccggatcggagtctgcaactcgactccgtgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgaaattcatgactgtgaaatgt

SEQ ID NO: 1129 - DNA, 1484 bp, Unknown
  source: /note="Description of Unknown: Uncultured seed derived bacterium of the family Comamonadaceae"
aatagagtttgatcctggctcagattgaacgctggcggcatgccttacacatgcaagtcgaacggcagcacgggagcaatcctggtggcgagtggcgaacgggtgagtaaagtatcggaacgtgcccagtcgtgggggataacgtagcgaaagttacgctaataccgcatacgatctatggatgaaagcgggggatcgcaagacctcgcgcgattggagcggccgatatcagattaggtagttggtggggtaaaggctcaccaagccgacgatctgtagctggtctgagaggacgaccagccacactgggactgagacacggcccagactcctacgggaggcagcagtggggaattttggacaatgggcgcaagcctgatccagccatgccgcgtgcaggatgaaggccttcgggttgtaaactgcttttgtacggaacgaaaaggtttgacttaatacgttggactcatgacggtaccgtaagaataagcaccggctaactacgtgccagcagccgcggtaatacgtagggtgcgagcgttaatcggaattactgggcgtaaagcgtgcgcaggcggttatgtaagacagatgtgaaatccccgggctcaacctgggaactgcattagtgactgcatagctggagtacggcagagggggatggaattccgcgtgtagcagtgaaatgcgtagatatgcggaggaacaccgatggcgaaggcaatcccctgggcctgtactgacgctcatgcacgaaagcgtggggagcaaacaggattagataccctggtagtccacgccctaaacgatgtcaactggttgttgggtcttcactgactcagtaacgaagctaacgcgtgaagttgaccgcctggggagtacggccgcaaggttgaaactcaaaggaattgacggggacccgcacaagcggtggatgatgtggtttaattcgatgcaacgcgaaaaaccttacccacctttgacatgtacggaagttaccagagatggtttcgtgctcgaaagagaaccgtaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttataggtggggctacacacgtcatacaatggctggtacagagggttgccaacccgcgagggggagctaatcccataaaaccagtcgtagtccggatcgcagtctgcaactcgactgcgtgaagtcggaatcgctagtaatcgcggatcagaatgtcgcggtgaatacgttcccgggtcttgtacacaccgcccgtcacaccatgggagcgggttctgccagaagtagttagcctaaccgcaaggagggcgattaccacggcagggttcgtgactggggtgaagtcgta

SEQ ID NO: 1130 - DNA, 1527 bp, Unknown
  source: /note="Description of Unknown: Uncultured seed derived bacterium of the family Oxalobacteraceae"
  modified_base (1517)..(1517): a, c, t or g
tgagcttgaatcctggctcagattgaacgctggcggcatgccttacacatgcaagtcgaacggcagcacggacttcggtctggtggcgagtggcgaacgggtgagtaatatatcggaacatacccagtagtgggggataactatccgaaaggatagctaataccgcatacgatctgtggatgaaagcaggggatcttcggaccttgtgctattggaatggccgatatctgattagctagttggtagggtaaaagcctaccaaggcgacgatcagtagctggtctgagaggacgaccagccacactggaactgagacacggtccagactcctacgggaggcagcagtggggaattttggacaatgggggcaaccctgatccagcaatgccgcgtgagtgaagaaggccctcgggttgtaaagctcttttgtcagggaagaaacggagttctctaatataggattctaatgacggtacctgaagaataagcaccggctaactacgtgccagcagccgcggtaatacgtagggtgcaagcgttaatcggaattactgggcgtaaagcgtgcgcaggcggttttgtaagtctgatgtgaaatccccgggctcaacctgggaactgcattggagactgcaaggctagagtgtgtcagaggggggtagaattccacgtgtagcagtgaaatgcgtagagatgtggaggaataccgatggcgaaggcagccccctgggataacactgacgctcatgcacgaaagcgtggggagcaaacaggattagataccctggtagtccacgccctaaacgatgtctactagttgtcgggacttaattgtcttggtaacgcagctaacgcgtgaagtagaccgcctggggagtacggtcgcaagattaaaactcaaaggaattgacggggacccgcacaagcggtggatgatgtggattaattcgatgcaacgcgaaaaaccttacctacccttgacatggcaggaatcccgaagagatttgggagtgctcgcaagagaacctgcacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtacatacagagggccgccaacccgcgagggggagctaatcccagaaagtgtatcgtagtccggattgtagtctgcaactcgactacatgaagttggaatcgctagtaatcgcggatcagcatgtcgcggtgaatacgttcccgggtcttgtacacaccgcccgtcacaccatgggagcgggttctgccagaagtaggtagcttaaccgcaaggagggcgcttaccacggcagggttcgtgactggggtgaagtcgtaacaaggtagccgtatcggaaggtgcgactggatcncttcctttct

SEQ ID NO: 1131 - DNA, 1508 bp, Unknown
  source: /note="Description of Unknown: Uncultured seed derived bacterium of the family Comamonadaceae"
  modified_base (13)..(14): a, c, t or g
  modified_base (811)..(813): a, c, t or g
  modified_base (1102)..(1102): a, c, t or g
tgatcatggctcnnattgaacgctggcggcatgccttacacatgcaagtcgaacggcagcacgggagcaatcctggtggcgagtggcgaacgggtgagtaaagtatcggaacgtgcccagtcgtgggggataacgtagcgaaagttacgctaataccgcatacgatctatggatgaaagcgggggatcgcaagacctcgcgcgattggagcggccgatatcagattaggtagttggtggggtaaaggctcaccaagccgacgatctgtagctggtctgagaggacgaccagccacactgggactgagacacggcccagactcctacgggaggcagcagtggggaattttggacaatgggcgcaagcctgatccagccatgccgcgtgcaggatgaaggccttcgggttgtaaactgcttttgtacggaacgaaaaggtttggcctaataagctgagctcatgacggtaccgtaagaataagcaccggctaactacgtgccagcagccgcggtaatacgtagggtgcgagcgttaatcggaattactgggcgtaaagcgtgcgcaggcggttatgtaagacagatgtgaaatccccgggctcaacctgggaactgcattagtgactgcatagctggagtacggcagagggggatggaattccgcgtgtagcagtgaaatgcgtagatatgcggaggaacaccgatggcgaaggcaatcccctgggcctgtactgacgctcatgcacgaaagcgtggggagcaaacaggattagataccctggtagtccacgccctaaacgatgtcaactggnnnttgggtcttcactgactcagtaacgaagctaacgcgtgaagttgaccgcctggggagtacggccgcaaggttgaaactcaaaggaattgacggggacccgcacaagcggtggatgatgtggtttaattcgatgcaacgcgaaaaaccttacccacctttgacatgtacggaagttaccagagatggtttcgtgctcgaaagagaaccgtaacacaggtgctgcatggctgtcgtcagctcgtgtcgtgagatgttgggttaagtcccgcaacgagcgcaacccttgtcnttagttgctacgaaagggcactctaatgagactgccggtgacaaaccggaggaaggtggggatgacgtcaagtcctcatggcccttataggtggggctacacacgtcatacaatggctggtacagagggttgccaacccgcgagggggagctaatcccataaaaccagtcgtagtccggatcgcagtctgcaactcgactgcgtgaagtcggaatcgctagtaatcgcggatcagaatgtcgcggtgaatacgttcccgggtcttgtacacaccgcccgtcacaccatgggagcgggttctgccagaagtagttagcctaaccgcaaggagggcgattaccacggcagggttcgtgactggggtgaagtcgtaacaaggtagccgtatcggaaggtgcggctggat

SEQ ID NO: 1132 - DNA, 1498 bp, Unknown
  source: /note="Description of Unknown: Uncultured seed derived bacterium of the family Pseudomonadaceae"
agagtttgatcatggctcagattgaacgctggcggcaggcctaacacatgcaagtcgagcggatgacgggagcttgctccttgattcagcggcggacgggtgagtaatgcctaggaatctgcctggtagtgggggacaacgtttcgaaaggaacgctaataccgcatacgtcctacgggagaaagcaggggaccttcgggccttgcgctatcagatgagcctaggtcggattagctagttggtggggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagtaagctaataccttgctgttttgacgttaccgacagaataagcaccggctaactctgtgccagcagccgcggtaatacagagggtgcaagcgttaatcggaattactgggcgtaaagcgcgcgtaggtggttcgttaagttggatgtgaaagccccgggctcaacctgggaactgcatccaaaactggcgagctagagtacggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttggaatccttgagattttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatgcagagaactttccagagatggattggtgccttcgggaactctgacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatctcacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtaacc

SEQ ID NO: 1133 - DNA, 1437 bp, Unknown
  source: /note="Description of Unknown: Uncultured seed derived bacterium of the family Sphingomonadaceae"
aatgaacgctggcggcatgcctaacacatgcaagtcgaacgaaggcttcggccttagtggcgcacgggtgcgtaacgcgtgggaatctgccctcaggttcggaataacagcgagaaattgctgctaataccggatgatatcgcgagatcaaagatttatcgcctgaggatgagcccgcgtaggattagctagttggtgtggtaaaggcgcaccaaggcgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggatgataatgacagtaccgggagaataagctccggctaactccgtgccagcagccgcggtaatacggagggagctagcgttattcggaattactgggcgtaaagcgcacgtaggcggctttgtaagttaraggtgaaagcctggagctcaactccagaattgcctttaaractgcatcgcttgaatccaggagaggtgagtggaattccgagtgtagaggtgaaattcgtagatattcggaagaacaccagtggcgaaggcggctcactggactggtattgacgctraggtgcgaaagcgtggggagcaaacaggattagataccctggtagtccacgccgtaaacgatgataactactgtcggggctcttagagcttcggtggcgcactaacgccttaagttttccgcctggggagtacggccgcaaggttaaaactcaaatgaattgacgggggcctgcacaagcggtggagcatgtggtttaattcgaagcaacgcgcaraaccttaccagcgtttgacatgtccggacgatttcgggagaccgatctcttcccttcggggactggaacacaggtgctgcatggctgtcgtcagctcgtgtcgtgagatgttgggttaagtcccgcaacgagcgcaaccctcgtcyttagttgccatcatttagttgggcactctaaggaaaccgccggtgataagccggaggaaggtggggatgacgtcaagtcctcatggcccttacgcgctgggctacacacgtgctacaatggcggtgacagtgggcagcaatctcgcaagggtgagctaatctccaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcagtgcgctaaccgcaaggaggcagctgaccacggtgggttcagcgactggggtgaagtcctaacaaggtagccgtaggggaactgc

SEQ ID NO: 1134 - DNA, 1374 bp, Unknown
  source: /note="Description of Unknown: Uncultured seed derived bacterium of the family Moraxellaceae"
cggcaggcttaccatgcaagtcgagcggggaaggtacttgctcctacctagcggcggacgggtgagtaatgcttaggaatctgcctattagtgggggacaacattccgaaaggaatgctaataccgcatacgtcctacgggagaaagcaggggaccttcgggccttgcgctaatagatgagcctaagtcggattagctagttggtggggtaaaggcctaccaaggcgacgatctgtagcgggtctgagaggatgatccgccacactgggactgagacacggcccagactcctacgggaggcagcagtggggaatattggacaatggggggaaccctgatccagccatgccgcgtgtgtgaagaaggccttttggttgtaaagcactttaagcgaggaggaggctactagtattaatactactggatagtggacgttactcgcagaataagcaccggctaactctgtgccagcagccgcggtaatacagagggtgcgagcgttaatcggatttactgggcgtaaagcgtgcgtaggcggctgattaagtcggatgtgaaatccctgagcttaacttaggaattgcattcgatactggtcagctagagtatgggagaggatggtagaattccaggtgtagcggtgaaatgcgtagagatctggaggaataccgatggcgaaggcagccatctggcctaatactgacgctgaggtacgaaagcatggggagcaaacaggattagataccctggtagtccatgccgtaaacgatgtctactagccgttggggcctttgaggctttagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggtcttgacatagtaagaactttccagagatggattggtgccttcgggaacttacatacaggtgctgcatggctgtcgtcagctcgtgtcgtgagatgttgggttaagtcccgcaacgagcgcaacccttttccttatttgccagcgggttaagccgggaactttaaggatactgccagtgacaaactggaggaaggcggggacgacgtcaagtcatcatggcccttacgaccagggctacacacgtgctacaatggtcggtacaaagggttgctacctagcgataggatgctaatctcaaaaagccgatcgtagtccggattggagtctgcaactcgactccatgaagtcggaatcgctagtaatcgcggatcagaatgccgcggtgaatacgttcccgggccttgtacacaccgcccgtcacaccatgggagtttg

SEQ ID NO: 1135 - DNA, 1459 bp, Unknown
  source: /note="Description of Unknown: Uncultured seed derived bacterium of the family Moraxellaceae"
  modified_base (128)..(129): a, c, t or g
  modified_base (173)..(173): a, c, t or g
aacgctggcggcaggcttaacacatgcaagtcgagcggatgaaggtagcttgctactggattcagcggcggacgggtgagtaatgcttaggaatctgcctattagtgggggacaacgttccgaaaggnncgctaataccgcatacgtcctacgggagaaagcaggggaccttngggccttgcgctaatagatgagcctaagtcggattagctagttggtagggtaaaggcctaccaaggcgacgatctgtagcgggtctgagaggatgatccgccacactgggactgagacacggcccagactcctacgggaggcagcagtggggaatattggacaatggggggaaccctgatccagccatgccgcgtgtgtgaagaaggccttttggttgtaaagcactttaagcgaggaggaggctacctagattaatactttaggatagtggacgttactcgcagaataagcaccggctaactctgtgccagcagccgcggtaatacagagggtgcgagcgttaatcggatttactgggcgtaaagcgtgcgtaggcggccaattaagtcaaatgtgaaatccccgagcttaacttgggaattgcattcgatactggttggctagagtatgggagaggatggtagaattccaggtgtagcggtgaaatgcgtagagatctggaggaataccgatggcgaaggcagccatctggcctaatactgacgctgaggtacgaaagcatggggagcaaacaggattagataccctggtagtccatgccgtaaacgatgtctactagccgttggggcccttgaggctttagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggccttgacatacagagaactttccagagatggattggtgccttcgggaactctgatacaggtgctgcatggctgtcgtcagctcgtgtcgtgagatgttgggttaagtcccgcaacgagcgcaacccttttccttatttgccagcacttcggttgggaactttaaggatactgccagtgacaaactggaggaaggcggggacgacgtcaagtcatcatggcccttacggccagggctacacacgtgctacaatggtcggtacaaagggttgctacacagcgatgtgatgctaatctcaaaaagccgatcgtagtccggattggagtctgcaactcgactccatgaagtcggaatcgctagtaatcgcggatcagaatgccgcggtgaatacgttcccgggccttgtacacaccgcccgtcacaccatgggagtttgttgcaccagaagtaggtagtctaaccgcaaggaggacgcttaccacggtgtggccgatgactggggtgaagt

SEQ ID NO: 1136 - DNA, 1460 bp, Unknown
  source: /note="Description of Unknown: Uncultured seed derived bacterium of the family Moraxellaceae"
  modified_base (578)..(578): a, c, t or g
  modified_base (763)..(764): a, c, t or g
  modified_base (1384)..(1384): a, c, t or g
aacgctggcggcaggcttaacacatgcaagtcgagcggggagaggtagcttgctacctaacctagcggcggacgggtgagtaatgcttaggaatctgcctattagtgggggacaacattccgaaaggaatgctaataccgcatacgccctacgggggaaagcaggggatcttcggaccttgcgctaatagatgagcctaagtcagattagctagttggtggggtaaaggcctaccaaggcgacgatctgtagcgggtctgagaggatgatccgccacactgggactgagacacggcccagactcctacgggaggcagcagtggggaatattggacaatgggcgaaagcctgatccagccatgccgcgtgtgtgaagaaggccttttggttgtaaagcactttaagcgaggaggaggctacttggattaatactctaggatagtggacgttactcgcagaataagcaccggctaactctgtgccagcagccgcggtaatacagagggtgcgagcgttaatcggatttactgggcgtaaagcgtgcgtaggcggctttttaagtcggatgtgaaatcccngagcttaacttaggaattgcattcgatactgggaagctagagtatgggagaggatggtagaattccaggtgtagcggtgaaatgcgtagagatctggaggaataccgatggcgaaggcagccatctggcctaatactgacgctgaggtacgaaagcatggggagcaaacaggattagataccctnntagtccatgccgtaaacgatgtctactagccgttggggcctttgaggctttagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggtcttgacatagtaagaactttccagagatggattggtgccttcgggaacttacatacaggtgctgcatggctgtcgtcagctcgtgtcgtgagatgttgggttaagtcccgcaacgagcgcaacccttttccttatttgccagcgggttaagccgggaactttaaggatactgccagtgacaaactggaggaaggcggggacgacgtcaagtcatcatggcccttacgaccagggctacacacgtgctacaatggtcggtacaaagggttgctacctagcgataggatgctaatctcaaaaagccgatcgtagtccggattggagtctgcaactcgactccatgaagtcggaatcgctagtaatcgcggatcagaatgccgcggtgaatacgttcccgggccttgtacacaccgcccgtcacaccatgggantttgttgcaccagaagtaggtagtctaaccgcaaggaggacgcttaccacggtgtggccgatgactggggtgaagt

SEQ ID NO: 1137 - DNA, 1461 bp, Unknown
  source: /note="Description of Unknown: Uncultured seed derived bacterium of the family Moraxellaceae"
aacgctggcggcaggcttaacacatgcaagtcgagcgggggaagttgcttcggtaactgacctagcggcggacgggtgagtaatacttaggaatctgcctattaatgggggacaacatctcgaaagggatgctaataccgcatacgccctacgggggaaagcaggggatcacttgtgaccttgcgttaatagatgagcctaagtcggattagctagttggtggggtaaaggcctaccaaggcgacgatctgtagcgggtctgagaggatgatccgccacactgggactgagacacggcccagactcctacgggaggcagcagtggggaatattggacaatggggggaaccctgatccagccatgccgcgtgtgtgaagaaggccttatggttgtaaagcactttaagcgaggaggaggctctcttggttaatacccaagatgagtggacgttactcgcagaataagcaccggctaactctgtgccagcagccgcggtaatacagagggtgcgagcgttaatcggatttactgggcgtaaagcgtgcgtaggcggctttttaagtcggatgtgaaatccccgagcttaacttgggaattgcattcgatactgggaagctagagtatgggagaggatggtagaattccaggtgtagcggtgaaatgcgtagagatctggaggaataccgatggcgaaggcagccatctggcctaatactgacgctgaggtacgaaagcatggggagcaaacaggattagataccctggtagtccatgccgtaaacgatgtctactagccgttggggcctttgaggctttagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggtcttgacatagtaagaactttccagagatggattggtgccttcgggaacttacatacaggtgctgcatggctgtcgtcagctcgtgtcgtgagatgttgggttaagtcccgcaacgagcgcaacccttttccttatttgccagcacttcgggtgggaactttaaggatactgccagtgacaaactggaggaaggcggggacgacgtcaagtcatcatggcccttacgaccagggctacacacgtgctacaatggtcggtacaaagggttgctacctagcgataggatgctaatctcaaaaagccgatcgtagtccggattggagtctgcaactcgactccatgaagtcggaatcgctagtaatcgcggatcagaatgccgcggtgaatacgttcccgggccttgtacacaccgcccgtcacaccatgggagtttgttgcaccagaagtaggtagtctaaccgtaaggaggacgcttaccacggtgtggccgatgactggggtgaagt

SEQ ID NO: 1138 - DNA, 1460 bp, Enterobacter sp.
  modified_base (1416)..(1416): a, c, t or g
aacgctggcggcaggcttaacacatgcaagtcgagcggggaaatgtagcttgctacctaacctagcggcggacgggtgagtaatgcttaggaatctgcctattagtgggggacaacatctcgaaagggatgctaataccgcatacgtcctacgggagaaagcaggggaccttcgggccttgcgctaatagatgagcctaagtcggattagctagttggtggggtaaaggcctaccaaggcgacgatctgtagcgggtctgagaggatgatccgccacactgggactgagacacggcccagactcctacgggaggcagcagtggggaatattggacaatggggggaaccctgatccagccatgccgcgtgtgtgaagaaggccttttggttgtaaagcactttaagcgaggaggaggctaccgagattaatactcttggatagtggacgttactcgcagaataagcaccggctaactctgtgccagcagccgcggtaatacagagggtgcaagcgttaatcggatttactgggcgtaaagcgcgcgtaggtggccaattaagtcaaatgtgaaatccccgagcttaacttgggaattgcattcgatactggttggctagagtatgggagaggatggtagaattccaggtgtagcggtgaaatgcgtagagatctggaggaataccgatggcgaaggcagccatctggcctaatactgacactgaggtgcgaaagcatggggagcaaacaggattagataccctggtagtccatgccgtaaacgatgtctactagccgttggggcctttgaggctttagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggtcttgacatagtaagaactttccagagatggattggtgccttcgggaacttacatacaggtgctgcatggctgtcgtcagctcgtgtcgtgagatgttgggttaagtcccgcaacgagcgcaacccttttccttatttgccagcgggttaagccgggaactttaaggatactgccagtgacaaactggaggaaggcggggacgacgtcaagtcatcatggcccttacgaccagggctacacacgtgctacaatggtcggtacaaagggttgctacctcgcgagaggatgctaatctcaaaaagccgatcgtagtccggattggagtctgcaactcgactccatgaagtcggaatcgctagtaatcgcggatcagaatgccgcggtgaatacgttcccgggccttgtacacaccgcccgtcacaccatgggagtttgttgcaccagaagtaggtagtctaaccgnaaggaggacgcttaccacggtgtggccgatgactggggtgaagt

SEQ ID NO: 1139 - DNA, 1475 bp, Enterobacter intermedius
tagagtttgatcctggctcagaacgaacgctggcggcaggcttaacacatgcaagtcgagcgccccgcaaggggagcggcagacgggtgagtaacgcgtgggaacgtaccctttactacggaataacgcagggaaacttgtgctaataccgtatgtgccctttgggggaaagatttatcggtaaaggatcggcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctctttcaccggagaagataatgacggtatccggagaagaagccccggctaacttcgtgccagcagccgcggtaatacgaagggggctagcgttgttcggaattactgggcgtaaagcgcacgtaggcggatcgatcagtcaggggtgaaatcccagggctcaaccctggaactgcctttgatactgtcgatctggagtatggaagaggtgagtggaattccgagtgtagaggtgaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatgcccggctacttgcagagatgcaaggttcccttcggggaccgggacacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggtagtgcgctaaccgcaaggaggcagctaaccacggtagggtcagcgactggggtgaagtcgtaacaaggtagccgtaggggaacctgcggctggatcacctcctta

SEQ ID NO: 1140 - DNA, 1462 bp, Curvibacter gracilis
ttgagtttgattcctggctcagattgaacgctggcggcatgccttacacatgcaagtcgaacggcagcacggacttcggtctggtggcgagtggcgaacgggtgagtaatacatcggaacgtgtcctggagtgggggatagcccggcgaaagccggattaataccgcatacgctctacggaggaaagggggggatctttcgggacctctcgctcaaggggcggccgatggcagattagctagttggtggggtaaaggcctaccaaggcgacgatctgtagctggtctgagaggacgaccagccacactgggactgagacacggcccagactcctacgggaggcagcagtggggaattttggacaatgggcgcaagcctgatccagcaatgccgcgtgtgtgaagaaggccttcgggttgtaaagcacttttgtccggaaagaaatcctctgccctaatacggcggggggatgacggtaccggaagaataagccccggctaactacgtgccagcagccgcggtaatacgtagggtgcaagcgttaatcggaattactgggcgtaaagcgtgcgcaggcggttcgctaagacagatgtgaaatccccgggcttaacctgggaactgcatttgtgactggcgggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgtcgggtcttcattgacttggtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtatggaatcctgctgagaggtgggagtgcccgaaagggagccataacacaggtgctgcatggctgtcgtcagctcgtgtcgtgagatgttgggttaagtcccgcaacgagcgcaacccttgtccctagttgctacgcaagagcactctagggagactgccggtgacaaaccggaggaaggtggggatgacgtcaagtcctcatggcccttatgggtagggcttcacacgtcatacaatggtcggaacagagggtcgccaacccgcgagggggagccaatcccagaaaaccgatcgtagtccggatcgcactctgcaactcgagtgcgtgaagctggaatcgctagtaatcgcggatcagcatgccgcggtgaatacgttcccgggtcttgtacacaccgcccgtcacaccatgggagtgggtttcaccagaagtaggtagcctaacctgcgaaggagggcgctaccacgtgatc

SEQ ID NO: 1141 - DNA, 1483 bp, Undibacterium sp.
  modified_base (1465)..(1465): a, c, t or g
tagagtttgatcctggctcagagcgaacgctggcggcaggcttaacacatgcaagtcgagcgggcatagcaatatgtcagcggcagacgggtgagtaacgcgtgggaacgtaccttttggttcggaacaactgagggaaacttcagctaataccggataagcccttacggggaaagatttatcgccgaaagatcggcccgcgtctgattagctagttggtgaggtaatggctcaccaaggcgacgatcagtagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctcttttgtgcgggaagataatgacggtaccgcaagaataagccccggctaacttcgtgccagcagccgcggtaatacgaagggggctagcgttgctcggaatcactgggcgtaaagggtgcgtaggcgggtctttaagtcaggggtgaaatcctggagctcaactccagaactgcctttgatactgaagatcttgagttcgggagaggtgagtggaactgcgagtgtagaggtgaaattcgtagatattcgcaagaacaccagtggcgaaggcggctcactggcccgatactgacgctgaggcacgaaagcgtggggagcaaacaggattagataccctggtagtccacgccgtaaacgatgaatgccagccgttagtgggtttactcactagtggcgcagctaacgctttaagcattccgcctggggagtacggtcgcaagattaaaactcaaaggaattgacgggggcccgcacaagcggtggagcatgtggtttaattcgacgcaacgcgcagaaccttaccagcccttgacatcccggtcgcggactccagagacggagttcttcagttcggctggaccggagacaggtgctgcatggctgtcgtcagctcgtgtcgtgagatgttgggttaagtcccgcaacgagcgcaacccccgtccttagttgctaccatttagttgagcactctaaggagactgccggtgataagccgcgaggaaggtggggatgacgtcaagtcctcatggcccttacgggctgggctacacacgtgctacaatggcggtgacaatgggatgctaaggggcgacccttcgcaaatctcaaaaagccgtctcagttcggattgggctctgcaactcgagcccatgaagttggaatcgctagtaatcgtggatcagcacgccacggtgaatacgttcccgggccttgtacacaccgcccgtcacaccatgggagttggttttacctgaagacggtgcgctaaccgaaagggggcagccggccacggtagggtcagcgactggggtgaagtcgtaacaaggtagccgtaggggaacctgnggctggatcacctcctta

SEQ ID NO: 1142 - DNA, 1340 bp, Pseudomonas lanceolata
gctgacgagtggcgaacgggtgagtaatgtatcggaacgtgcccagtcgtgggggataactgctcgaaagagcagctaataccgcatacgacctgagggtgaaagcgggggatcgcaagacctcgcgcgattggagcggccgatatcagattaggtagttggtggggtaaaggctcaccaagccaacgatctgtagctggtctgagaggacgaccagccacactgggactgagacacggcccagactcctacgggaggcagcagtggggaattttggacaatgggcgcaagcctgatccagccatgccgcgtgcgggaagaaggccttcgggttgtaaaccgcttttgtcagggaagaaaaggttctggctaatacctgggactcatgacggtacctgaagaataagcaccggctaactacgtgccagcagccgcggtaatacgtagggtgcaagcgttaatcggaattactgggcgtaaagcgtgcgcaggcggttatgcaagacagaggtgaaatccccgggctcaacctgggaactgcctttgtgactgcatagctagagtgcggcagagggggatggaattccgcgtgtagcagtgaaatgcgtagatatgcggaggaacaccgatggcgaaggcaatcccctgggcctgcactgacgctcatgcacgaaagcgtggggagcaaacaggattagataccctggtagtccacgccctaaacgatgtcaactggttgttgggagggtttcttctcagtaacgtagctaacgcgtgaagttgaccgcctggggagtacggccgcaaggttgaaactcaaaggaattgacggggacccgcacaagcggtggatgatgtggtttaattcgatgcaacgcgaaaaaccttacctacccttgacatgtctggaatcctgaagagatttgggagtgctcgaaagagagccagaacacaggtgctgcatggccgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaggtcatcatggcccttatgggtagggctacacacgtcatacaatggccgggacagagggctgccaacccgcgagggggagctaatcccagaaacccggtcgtagtccggatcgtagtctgcaactcgactgcgtgaagtcggaatcgctagtaatcgcggatcagcttgccgcggtgaatacgttcccgggtcttgtacacaccgcccgtcacaccatgggagcgggttctgccagaagtag

SEQ ID NO: 1143 - DNA, 1495 bp, Pseudomonas plecoglossicida
  modified_base (668)..(668): a, c, t or g
ttgaacgctagcgggatgccttacacatgcaagtcgaacggcagcacggacttcgtctggtggcgagtggcgaacgggtgagtaatgtatcggaacgtgcccagtagcgggggataactacgcgaaagcgtagctaataccgcatacgccctacgggggaaagcaggggatcgcaagaccttgcactattggagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcgcgggttaatacctcgcgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagcttaactttggaactgcatttttaactaccgggctagagtgtgtcagagggaggtggaattccgcgtgtagcagtgaaatgcgtanatatgcggaggaacaccgatggcgaaggcagcctcctgggataacactgacgctcatgcaccaaagcgtggggagcaaacaggattagataccctggtagtccacgccctaaacgatgtcaactagctgttggggccttcgggccttggtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaatgccgaagagatttggcagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgattaccacggtaggattcatgactggggtgaagtcgtaacaaggtagccgtatcggaaggtgcggctggatcac

SEQ ID NO: 1144 - DNA, 1435 bp, Sphingomonas echinoides
cgaacgctggcggcaggcttaacacatgcaagtcgaacgggcttcttcggaagtcagtggcagacgggtgagtaacacgtgggaacgtgcccttcggttcggaataactcagggaaacttgagctaataccggatacgcccttttggggaaaggttgactgccgaaggatcggcccgcgtctgattagcttgttggtggggtaacggcctaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctcttttgtccgggacgataatgacggtaccggaagaataagccccggctaacttcgtgccagcagccgcggtaatacgaagggggctagcgttgctcggaatcactgggcgtaaagggcgcgtaggcggccgattaagtcgggggtgaaagcctgtggctcaaccacagaattgccttcgatactggttggcttgagaccggaagaggacagcggaactgcgagtgtagaggtgaaattcgtagatattcgcaagaacaccagtggcgaaggcggctgtctggtccggttctgacgctgaggcgcgaaagcgtggggagcaaacaggattagataccctggtagtccacgccgtaaacgatgaatgccagccgttggcctgcttgcaggtcagtggcgccgctaacgcattaagcattccgcctggggagtacggtcgcaagattaaaactcaaaggaattgacgggggcccgcacaagcggtggagcatgtggtttaattcgaagcaacgcgcagaaccttaccatcccttgacatggcatgttaccccgagagatcggggatcctcttcggaggcgtgcacacaggtgctgcatggctgtcgtcagctcgtgtcgtgagatgttgggttaagtcccgcaacgagcgcaacccacgtccttagttgccatcattcagttgggcactctagggagactgccggtgataagccgcgaggaaggtgtggatgacgtcaagtcctcatggcccttacgggatgggctacacacgtgctacaatggcggtgacagagggacgcgaaaccgcgaggttgagcaaatccccaaaagccgtctcagttcggattgcactctgcaactcgggtgcatgaaggcggaatcgctagtaatcgtggatcagcacgccacggtgaatacgttcccgggccttgtacacaccgcccgtcacaccatgggagttggtcttacccgacggcgctgcgccaaccgcaaggaggcaggcgaccacggtagggtcagcgactggggtgaagtcgtaacaaggtagccgtaggggaacc

SEQ ID NO: 1145 - DNA, 1500 bp, Acinetobacter beijerinckii
  modified_base (563)..(563): a, c, t or g
agtgaacgctggcggcaggcctaacacatgcaagtcgamcggcagcacaggagagcttgctctctgggtggcgagtggcggacgggtgaggaatacatcggaatctaccttttcgtgggggataacgtagggaaacttacgctaataccgcatacgaccttagggtgaaagcggaggaccttcgggcttcgcgcggatagatgagccgatgtcggattagctagttggcggggtaaaggcccaccaaggcgacgatccgtagctggtctgagaggatgatcagccacactggaactgagacacggtccagactcctacgggaggcagcagtggggaatattggacaatgggcgcaagcctgatccagccatgccgcgtgggtgaagaaggccttcgggttgtaaagcccttttgttgggaaagaaaagcagtcggttaatacccgattgttctgacggtacccaaagaataagcaccggctaacttcgtgccagcagccgcggtaatacgaagggtgcaagcgttactcggaattactgggcgtaaagcgtgcgtaggtggtngtttaagtccgttgtgaaagccctgggctcaacctgggaattgcagtggatactgggtcactagagtgtggtagagggtagcggaattcccggtgtagcagtgaaatgcgtagagatcgggaggaacatctgtggcgaaggcggccatctggaccaacactgacactgaggcacgaaagcgtggggagcaaacaggattagataccctggtagtccacgccctaaacgatgcgaactggatgttgggtgcaacttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggtcttgacatccacggaactttccagagatggattggtgccttcgggaaccgtgagacaggtgctgcatggctgtcgtcagctcgtgtcgtgagatgttgggttaagtcccgcaacgagcgcaacccttgtccttagttgccagcacgtaatggtgggaactttaaggagaccgccggtgacaaaccggaggaaggtggggatgacgtcaagtcatcatggcccttacgaccagggctacacacgtactacaatggtagggacagagggctgcaagccggcgacggtgagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgcttgccacggtgtggccgatgactggggtgaagtcgtaacaaggtagccgtatcggaaggtgc

SEQ ID NO: 1146 - DNA, 1522 bp, Acinetobacter radioresistens
  modified_base (11)..(12): a, c, t or g
agggtttgatnntggctcagattgaacgctggcggcatgccttacacatgcaagtcgaacggtaacaggtcttcggatgctgacgagtggcgaacgggtgagtaatacatcggaacgtgcccagtaatgggggatagctcggcgaaagccggattaataccgcatacgccctgagggggaaagtgggggaccgcaaggcctcacgttattggagcggccgatggctgattagctagttggtagggtaaaggcctaccaaggcgacgatcagtagctggtctgagaggacgatcagccacactgggactgagacacggcccagactcctacgggaggcagcagtggggaattttggacaatgggggaaaccctgatccagcaatgccgcgtgtgcgaagaaggccttcgggttgtaaagcacttttgtcagggaagaaatcctttgggctaataccctagggggatgacggtacctgaagaataagcaccggctaactacgtgccagcagccgcggtaatacgtagggtgcgagcgttaatcggaattactgggcgtaaagcgtgcgcaggcggttgtgtaagacaggtgtgaaatccccgggcttaacctgggaattgcatttgtgactgcacgactagagtgtgtcagaggggggtggaattccacgtgtagcagtgaaatgcgtagatatgtggaggaacaccaatggcgaaggcagccccctgggataacactgacgctcatgcacgaaagcgtggggagcaaacaggattagataccctggtagtccacgccctaaacgatgtcaactagttgttggggatttacttccttggtaacgtagctaacgcgtgaagttgaccgcctggggagtacggccgcaaggttaaaactcaaaggaattgacggggacccgcacaagcggtggatgatgtggattaattcgatgcaacgcgaaaaaccttacctacccttgacatggcaggaactttccagagatggattggtgctcgaaagagaacctgcacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcggtacagagggttgccaagccgcgaggtggagccaatcccagaaaaccgatcgtagtccggatcgcagtctgcaactcgactgcgtgaagtcggaatcgctagtaatcgcggatcagaatgccgcggtgaatacgttcccgggtcttgtacacaccgcccgtcacaccatgggagtgggttctaccagaagtggctagtctaaccgcaaggaggacggtcaccacggtaggattcatgactggggtgaagtcgtaacaaggtagccgtatcggaaggtgcggctggatcacctccttt

SEQ ID NO: 1147 - DNA, 1437 bp, Acinetobacter johnsonii
  modified_base (775)..(775): a, c, t or g
aacgaacgctggcggcaggcttaacacatgcaagtcgaacgcatcgcaagatgagtggcagacgggtgagtaacgcgtgggaacatacccttttctacggaatagctctgggaaactggaattaataccgtatacgccctacgggggaaagatttatcggggaaggattggcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctctttcaccgatgaagataatgacggtagtcggagaagaagccccggctaacttcgtgccagcagccgcggtaatacgaagggggctagcgttgttcggaattactgggcgtaaagcgcacgtaggcggatatttaagtcaggggtgaaatcccagagctcaactctggaactgcctttgatactgggtatcttgagtatggaagaggtaagtggaattgcgagtgtagaggtgaaattcgtagatattcgcaggaacaccagtggcgaaggcggcttactggtccattactgacgctgaggtgcgaaagcgtggggagcaaacaggattagataccctggtagtccacgccgtaaacgatgaatgttagccgtcgggcagtatactgttcggtggcgcagntaacgcattaaacattccgcctggggagtacggtcgcaagattaaaactcaaaggaattgacgggggcccgcacaagcggtggagcatgtggtttaattcgaagcaacgcgcagaaccttaccagctcttgacattcggggtatggtcattggagacgatgaccttcagttcggctggccctagaacaggtgctgcatggctgtcgtcagctcgtgtcgtgagatgttgggttaagtcccgcaacgagcgcaaccctcgcccttagttgccagcatttggttgggcactctaaggggactgccggtgataagccgagaggaaggtggggatgacgtcaagtcctcatggcccttacgggctgggctacacacgtgctacaatggtggtgacagtgggcagcgagacagcgatgtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttttacccgaaggcgctgcgctaaccgcaagggggcaggcgaccacggtagggtcagcgactggggtgaagtcgtaacaaggtagccgtaggggaacc

SEQ ID NO: 1148 - DNA, 1511 bp, Acinetobacter sp.
tttgatcatgtctcagattgaacgctggcggcatgccttacacatgcaagtcgaacggtaacaggtcttcggatgctgacgagtggcgaacgggtgagtaatacatcggaacgtgcccgatcgtgggggataacggagcgaaagctttgctaataccgcatacgatctacggatgaaagcaggggaccgcaaggccttgcgcggacggagcggccgatggcagattaggtagttggtgggataaaagcttaccaagccgacgatctgtagctggtctgagaggacgaccagccacactgggactgagacacggcccagactcctacgggaggcagcagtggggaattttggacaatgggcgaaaggctgatccagccatgccgcgtgaaggatgaaggccttcgggttgtaaactgctttggtacggaacgaaaagactccttctaataaggggggtccatgacggtaccgtaagaataagcaccggctaactacgtgccagcagccgcggtaatacgtagggtgcaagcgttaatcggaattactgggcgtaaagcgtgcgcaggcggttatataagacagatgtgaaatccccgggctcaacctgggaactgcatttgtgactgtatagctagagtacggtagagggggatggaattccgcgtgtagcagtgaaatgcgtagatatgcggaggaacacccatggcgaaggcaatcccctggacctgtactgacgctcatgcacgaaagcgtggggagcaaacaggattagataccctggtagtccacgccctaaacgatgtcaactggttggtgggtcttcactgactcagtaacgaagctaacgcgtgaagttgaccgcctggggagtacggccgcaaggttgaaactcaaaggaattgacggggacccgcacaagcggtggatgatgtggtttaattcgatgcaacgcgaaaaaccttacccacctttgacatgtacggaatcctttagagatagaggagtgctcgaaagagaaccgtaacacaggtgctgcatggctgtcgtcagctcgtgtcgtgagatgttgggttaagtcccgcaacgagcgcaacccttgtcattagttgctacatttagttgggcactctaatgagactgccggtgacaaaccggaggaaggtggggatgacgtcaagtcctcatggcccttataggtggggctacacacgtcatacaatggctggtacagagggttgccaacccgcgagggggagccaatcccataaagccagtcgtagtccggatcgcagtctgcaactcgactgcgtgaagtcggaatcgctagtaatcgcggatcagaatgtcgcggtgaatacgttcccgggtcttgtacacaccgcccgtcacaccatgggagcgggttctgccagaagtaggtagcctaaccgtaaggagggcgcttaccacggcagggttcgtgactggggtgaagtcgtaacaaggtagccgtatcggaaggtgcggttgga

SEQ ID NO: 1149 - DNA, 1473 bp, Acinetobacter lwoffii
ggcctaacacatgcaagtctgacggtagcacagaggagcttgctccttgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaatggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatggggttaataaccttgtcgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaatttggcagagatgccttagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtagggg

SEQ ID NO: 1150 - DNA, 1347 bp, Rhizobium pisi
ggacgggtgagtaatgtctgggaaactgcccgatggagggggataactactggaaacggtagctaataccgcataacgtcgcragaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataacctygccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggygtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggytcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcg

SEQ ID NO: 1151 - DNA, 1470 bp, Burkholderia ginsengisoli
tggctcagattgaacgctggcggcatgccttacacatgcaagtcgaacggtaacgcggggcaacctggcgacgagtggcgaacgggtgagtaatgcatcggaacgtgcccagtagtgggggatagcccggcgaaagccggattaataccgcatacgacctacgggtgaaagggggggatcgcaagacctctcgctattggagcggccgatgtcagattagctagttggtggggtaaaggcctaccaaggcgacgatctgtagctggtctgagaggacgaccagccacactgggactgagacacggcccagactcctacgggaggcagcagtggggaattttggacaatgggggcaaccctgatccagccatgccgcgtgcgggaagaaggccttcgggttgtaaaccgcttttgtcggggaagaaacggtctgcgctaataccgcgggctaatgacggtacccgaagaataagcaccggctaactacgtgccagcagccgcggtaatacgtagggtgcaagcgttaatcggaattactgggcgtaaagcgtgcgcaggcggctttgcaagacagatgtgaaatccccgggctcaacctgggaactgcatttgtgactgcatggctggagtgcggcagagggggatggaattccgcgtgtagcagtgaaatgcgtagatatgcggaggaacaccgatggcgaaggcaatcccctgggcctgcactgacgctcatgcacgaaagcgtggggagcaaacaggattagataccctggtagtccacgccctaaacgatgtcaactggttgttggacggcttgctgttcagtaacgaagctaacgcgtgaagttgaccgcctggggagtacggccgcaaggttgaaactcaaaggaattgacggggacccgcacaagcggtggatgatgtggtttaattcgatgcaacgcgaaaaaccttacctacccttgacatgccaggaacttgccagagatggcttggtgctcgaaagagaacctggacacaggtgctgcatggccgtcgtcagctcgtgtcgtgagatgttgggttaagtcccgcaacgagcgcaacccttatcattagttgctacgcaagggcactctaatgagactgccggtgacaaaccggaggaaggtggggatgacgtcaggtcatcatggcccttatgggtagggctacacacgtcatacaatggccggtacacagggctgccaacccgcgagggggagctaatctcaaaaaaccgggcgtagtccggatcgcagtctgcaactcgactgcgtgaagtcggaatcgctagtaatcgcggatcagcttgccgcggtgaatacgttcccgggtcttgtacacaccgcccgtcacaccatgggagcgggttctgccagaagtagttagcctaaccgcaaggggggcgattaccacggcagggttcgtgactggggtgaagtcgtacaa

SEQ ID NO: 1152 - DNA, 1540 bp, Bradyrhizobium pachyrhizi
gtttgatcctggctcaggacgaacgctggcggcgtgcctaatacatgcaagtcgagcgaatcgacgggagcttgctccctgagattagcggcggacgggtgagtaacacgtgggcaacctgcctataagactgggataacttcgggaaaccggagctaataccggatacgttcttttctcgcatgagagaagatggaaagacggtttacgctgtcacttatagatgggcccgcggcgcattagctagttggtgaggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgaagaaggccttcgggtcgtaaagttctgttgttagggaagaacaagtaccagagtaactgctggtaccttgacggtacctaaccagaaagccacggctaactacgtgccagcagccgcggtaatacgtaggtggcaagcgttgtccggaattattgggcgtaaagcgcgcgcaggtggttccttaagtctgatgtgaaagcccacggctcaaccgtggagggtcattggaaactggggaacttgagtgcagaagaggaaagtggaattccaagtgtagcggtgaaatgcgtagagatttggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaaccctagagatagggctttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaaacctgcgaaggtaagcgaatcccataaagccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtgaggtaaccttcatggagccagccgcctaaggtgggacagatgattggggtgaagtcgtaacaaggtagccgtatcggaaggtgcggctggatcacctcctt

SEQ ID NO: 1153 - DNA, 1491 bp, Pelomonas puraquae
ggctcaggatgaacgctagcggcaggcctaatacatgcaagtcggacgggatccatcggtagcttgctaccgatggtgagagtggcgcacgggtgcgtaacgcgtgagcaacctgcccatatcagggggatagcccggagaaatccggattaacaccgcatgacactgctttccggcatcgggaggtggtcaaatattcataggatatggatgggctcgcgtgacattagctagttggtggggtaacggcccaccaaggcgacgatgtctaggggctctgagaggagaatcccccacactggtactgagacacggaccagactcctacgggaggcagcagtaaggaatattggtcaatgggggcaaccctgaaccagccatgccgcgtgcaggacgactgccctatgggttgtaaactgcttttgttagggaataaaccccgctacgtgtagcgggctgaatgtacctaaagaataaggatcggctaactccgtgccagcagccgcggtaatacggaggatccgagcgttatccggatttattgggtttaaagggtgcgtaggcggcactttaagtcaggggtgaaagacggcagctcaactgtcgcagtgcccttgatactgaagtgcttgaatgcggttgaagacggcggaatgagacaagtagcggtgaaatgcatagatatgtctcagaacaccgattgcgaaggcagctgtctaagccgttattgacgctgatgcacgaaagcgtggggatcgaacaggattagataccctggtagtccacgccctaaacgatgatgactcgatgtttgcgatataccgtaagcgtccaagcgaaagcgttaagtcatccacctggggagtacgcccgcaagggtgaaactcaaaggaattgacgggggcccgcacaagcggaggagcatgtggtttaattcgatgatacgcgaggaaccttacccgggcttgaaagttactgaagggcgcagagacgcgcccgtccttcgggacaggaaactaggtgctgcatggctgtcgtcagctcgtgccgtgaggtgttgggttaagtcccgcaacgagcgcaacccctatgtttagttgccagcacgtcaaggtggggactctaaacagactgcctgcgcaagcagagaggaaggcggggacgacgtcaagtcatcatggcccttacgtccggggctacacacgtgctacaatggatggtacagcgggcagctacacagcaatgtggtgccaatctcgaaaagccattcacagttcggatcggggtctgcaactcgaccccgtgaagttggattcgctagtaatcgcgtatcagcaatgacgcggtgaatacgttcccgggccttgtacacaccgcccgtcaagccatgaaagctgggggtacctaaagcatgtaaccgcaaggagcgtgttagggtaaaaccggtaattggggctaagtcgtaacaaggtagccgtaccggaaggtgcg

SEQ ID NO: 1154 - DNA, 1540 bp, Achromobacter xylosoxidans
ctggctcaggatgaacgctagcggcaggcttaatacatgcaagtcgaggggcagcatgactgtagcaatacagttgatggcgaccggcaaacgggtgcggaacacgtacgcaacctacccaaaactgggggatagcccggggaaacccggattaatacctcgtaacctagtggagtggcatcactttattagtatagctccggcggttttggatgggcgtgcgcctgattaggtagttggtgagggtaacggcccaccaagcctgcgatcagtaactggtgtgagagcacgaccagtcacacgggcactgagacacgggcccgactcctacgggaggcagcagtaaggaatattggtcaatggacgcaagtctgaaccagccatgccgcgtgaaggatgaaggtcctctggattgtaaacttcttttatatgggacgaaacccgggaattccttcccgattgacggtaccataagaataagcaccggctaactccgtgccagcagccgcggtaatacggagggtgcaagcgttatccggattcactgggtttaaagggtgcgtaggagggtaggtaagtcagtggtgaaatcttcgagcttaactcggaaactgccgttgatactatctatcttgaataccgtggaggtgagcggaatatgtcatgtagcggtgaaatgcttagatatgacatagaacaccaattgcgaaggcagctcgctacacgaatattgactctgaggcacgaaagcgtggggatcaaacaggattagataccctggtagtccacgccctaaacgatggatactcgacatacgcgatacacagtgtgtgtctgagcgaaagcattaagtatcccacctgggaagtacgaccgcaaggttgaaactcaaaggaattggcgggggtccgcacaagcggtggagcatgtggtttaattcgatgatacgcgaggaaccttacctgggctagaatgtagtctgaccgtgggtgaaagctcattttgtagcaatacacagattataaggtgctgcatggctgtcgtcagctcgtgccgtgaggtgttgggttaagtcccgcaacgagcgcaacccccatcactagttgccatcaggtaacgctgggaactctagtgaaactgccgtcgtaagacgcgaggaaggaggggatgatgtcaagtcatcatggcctttatgcccagggctacacacgtgctacaatggggcgtacaaagggctgccacttagcgataaggagccaatcccaaaaaacgcctctcagttcagattggagtctgcaactcgactccatgaagctggaatcgctagtaatcgtatatcagcaatgatacggtgaatacgttcccggaccttgcacacaccgcccgtcaagccatggaagctgggtgtacctaaagtcggtaaccgcaaggagccgcctaggtaaaactagtaactggggctaagtcgtaacaaggtagccgtatcggaaggtgcggctggaatacctcctttttagagcacgatcctctgggtccgccc

SEQ ID NO: 1155 - DNA, 1446 bp, Methylobacterium rhodesianum
gagtttgatcctggctcaggatgaacgctagcgggaggcctaacacatgcaagccgagcggtatgattctttcgggaatcagagagcggcgtacgggtgcggaacacgtgtgcaacctgcctttatctgggggatagcctttcgaaaggaagattaataccccataatatattgagtggcatcacttaatattgaaaactccggtggatagagatgggcacgcgcaagattagatagttggtggggtaacggcctaccaagtcgatgatctttagggggcctgagagggtgatcccccacactggtactgagacacggaccagactcctacgggaggcagcagtgaggaatattggacaatgggtgcaagcctgatccagccatcccgcgtgaaggacgacggccctatgggttgtaaacttcttttgtacagggataaacctagatacgtgtatctagctgaaggtactgtacgaataagcaccggctaactccgtgccagcagccgcggtaatacggagggtgcaagcgttatccggatttattgggtttaaagggtccgtaggcggatcagtaagtcagtggtgaaatctcatagcttaactatgaaactgccattgatactgctggtcttgagtaaggtagaagtagctggaataagtagtgtagcggtgaaatgcatagatattacttagaacaccaattgcgaaggcaggttactatgtcttaactgacgctgatggacgaaagcgtggggagcgaacaggattagataccctggtagtccacgctgtaaacgatgctaactcgtttttgggttttcggattcagagactaagcgaaagtgataagttagccacctggggagtacgaacgcaagtttgaaactcaaaggaattgacgggggcccgcacaagcggtggattatgtggtttaattcgatgatacgcgaggaaccttaccaaggcttaaatgggaattgatcggtttagaaatagaccttccttcgggcaattttcaaggtgctgcatggttgtcgtcagctcgtgccgtgaggtgttaggttaagtcctgcaacgagcgcaacccctgtcactagttgccatcattaagttggggactctagtgagactgcctacgcaagtagagaggaaggtggggatgacgtcaaatcatcacggcccttacgccttgggccacacacgtaatacaatggccggtacagagggcagctacacagcgatgtgatgcaaatctcgaaagccggtctcagttcggattggagtctgcaactcgactctatgaagctggaatcgctagtaatcgcgcatcagccatggcgcggtgaatacgttcccgggccttgtacacaccgcccgtcaagccatggaagtctggggtacctgaagtcggtgaccgtaaaaggagctgcctagggtaaaacag

SEQ ID NO: 1156 - DNA, 1488 bp, Xanthomonas sacchari
cctggctcaggatgaacgctggcggcgtgcttaacacatgcaagtcgaacgatgatcccagcttgctgggggattagtggcgaacgggtgagtaacacgtgagtaacctgcccttgactctgggataagcctgggaaactgggtctaataccggatacgaccatctggcgcatgtcatggtggtggaaagcttttgtggttttggatggactcgcggcctatcagcttgttggtggggtaatggcctaccaaggcgacgacgggtagccggcctgagagggtgaccggccacactgggactgagacacggcccagactcctacgggaggcagcagtggggaatattgcacaatgggcgcaagcctgatgcagcgacgccgcgtgagggatgacggccttcgggttgtaaacctctttcagtagggaagaagcgaaagtgacggtacctgcagaagaagcgccggctaactacgtgccagcagccgcggtaatacgtagggcgcaagcgttatccggaattattgggcgtaaagagctcgtaggcggtttgtcgcgtctgctgtgaaagaccggggctcaactccggttctgcagtgggtacgggcagactagagtgcagtaggggagactggaattcctggtgtagcggtgaaatgcgcagatatcaggaggaacaccgatggcgaaggcaggtctctgggctgtaactgacgctgaggagcgaaagcatggggagcgaacaggattagataccctggtagtccatgccgtaaacgttgggcactaggtgtgggggacattccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgaaccggaaagacctggaaacaggtgccccgcttgcggtcggtttacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggacgacgtcaaatcatcatgccccttatgtcttgggcttcacgcatgctacaatggccggtacaaagggttgcgatactgtgaggtggagctaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagttggtaacacccgaagccggtggcctaacccttgtggggggagccgtcgaaggtgggaccggcgattgggactaagtcgtaacaaggtagccgtaccggaaggtgcgg

SEQ ID NO: 1157 - DNA, 1313 bp, Limnobacter thiooxidans
ggcgagtggcgaacgggtgagtaatacatcggaacatgtcctgtagtgggggatagcccggcgaaagccggattaataccgcatacgatctacggatgaaagcgggggaccttcgggcctcgcgctatagggttggccgatggctgattagctagttggtggggtaaaggcccaccaaggcgacgatcagtagctggtctgagaggacgaccagccacactgggactgagacacggcccacactcctacgggaggcagcagtggggaattttggacaatgggcgaaagcctgatccagcaatgccgcgtgtgtgaagaaggccttcgggttgtaaagcacttttgtccggaaagaaatcctgagggtaatatccttcggggatgacggtaccggaagaataagcaccggctaactacttgccaccacccgcggtaatacgtagggtgcgagcgttaatcggaattactgggcgtaaagcgtgcgcaggcggtttgttaagaccgatgtgaaatccccgggctcaacctgggaactgcattggtgactggcaagctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctagagagatctgggagtgctcgaaagagaaccgatacacaggtgctgcatggctgtcgtcagctcgtgtcgtgagatgttgggttaagtcccgcaacgagcgcaacccttgtccttagttgctacgcaagagcactctagggagactgccggtgacaaaccggaggaaggtggggatgacgtcaagtcctcatggcccttatgggtagggcttcacacgtcatacaatggtcggaacagagggtcgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatg

SEQ ID NO: 1158 - DNA, 1549 bp, Agrobacterium larrymoorei
acacatgcaagtcgaacggcagcacgggtgcttgcacctggtggcgagtggcgaacgggtgagtaatacatcggaacatgtcctgtagtgggggatagcccggcgaaagccggattaataccgcatacgatctacggatgaaagcgggggatctttggacctcgcgctatagggttggccgatggctgattagctagttggtggggtaaaggcctaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatcctgagggctaatatccttcggggatgacggtaccggaagaataagcaccggctaactacgtgccagcagccgcggtaatacgtagggtgcgagcgttaatcggaattactgggcgtaaagcgtgcgcaggcggtttgttaagaccgatgtgaaatccccgggctcaacctgggaactgcattggtgactggcaagctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcccgaagagatttgggagtgctcgaaagagaaccgatacacaggtgctgcatggctgtcgtcagctcgtgtcgtgagatgttgggttaagtcccgcaacgagcgcaacccttgtccttagttgctacgcaagagcactctaaggagactgccggtgacaaaccggaggaaggtggggatgacgtcaagtcctcatggcccttatgggtagggcttcacacgtcatacaatggtcggaacagagggtcgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtagccgtatcggaaggtgcggctggatcacctcctttctcgagctaataccgcatacattgagcgttcacgcttatcggctgttgatcaagacagactcaggg

SEQ ID NO: 1159 - DNA, 1347 bp, Acidovorax facilis; identical to SEQ ID NO: 1150

SEQ ID NO: 1160 - DNA, 1485 bp, Pantoea agglomerans
attgaacgctggcggcatgccttacacatgcaagtcgaacggcagcacgggtgcttgcacctggtggcgagtggcgaacgggtgagtaatatatcggaacgtaccttgtagtgggggatagctmggcgaaagccggattaataccgcatacgctctgaggaggaaagcgggggaccttcgggcctcgcgctacaagagcggccgatatcagattagctagttggtggggtaaaagcttaccaaggcgacgatctgtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatcctctgggttaatacctcggggggatgacggtaccggaagaataagcaccggctaactacgtgccagcagccgcggtaatacgtagggtgcgagcgttaatcggaattactgggcgtaaagcgtgcgcaggcggttttgtaagacggatgtgaaatccccgggctcaacctgggaactgcattcgtgactgcaaggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtacggaagtctgctgagaggcggatgtgctcgaaagagaaccgtaacacaggtgctgcatggctgtcgtcagctcgtgtcgtgagatgttgggttaagtcccgcaacgagcgcaacccttgtccttagttgctacgcaagagcactctaaggagactgccggtgacaaaccggaggaaggtggggatgacgtcaagtcctcatggcccttatgggtagggcttcacacgtcatacaatggtcggtacagagggctgccaaaccgcgaggtggagctaaccccagaaaaccgatcgtagtccggatcgcagtctgcaactcgactgcgtgaagctggaatcgctagtaatcgcggatcagcatgtcgcggtgaatacgttcccgggtcttgtacacaccgcccgtcacaccatgggagtgggttttgccagaagtaggtagcctaaccgtaaggagggcgcttaccacggcaggattcatgactggggtgaagtcgtaacaaggtagccgtakgggaacc

SEQ ID NO: 1161 - DNA, 1473 bp, Pantoea dispersa; identical to SEQ ID NO: 1149

SEQ ID NO: 1162 - DNA, 1522 bp, Methylibium aquaticum; identical to SEQ ID NO: 1146
  modified_base (11)..(12): a, c, t or g

SEQ ID NO: 1163 - DNA, 1495 bp, Brevibacterium frigoritolerans
attgaacgctggcggcaggcctaacacatgcaagtcgarcggtarcacagagagcttgctctcgggtgacgagyggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaascctgatgcagccatgccgcgtgtatgaagaaggccttcgggttgtaaagtactttcagcggggaggaaggcgataaggttaataaccttgtcgattgacgttacccgcagaaraagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggtcmggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaacctycgggagggcgcttaccactttgtgattcatgactggggtgaagtcgtaacaaggtaaccgtaggggaacctgc

SEQ ID NO: 1164 - DNA, 1519 bp, Flavobacterium mizutaii
  modified_base (273)..(274): a, c, t or g
  modified_base (279)..(279): a, c, t or g
  modified_base (1459)..(1462): a, c, t or g
tggctcagagtgaacgctggcggtaggcctaacacatgcaagtcgaacggcagcacagaggagcttgctccttgggtggcgagtggcggacgggtgaggaatacatcggaatctactttttcgtgggggataacgtagggaaacttacgctaataccgcatacgacctacgggtgaaagcaggggatcttcggaccttgcgcgattgaatgagccgatgtcggattagctagttggcggggtaaaggcccaccaaggcgacgatccgtagctnntctgngaggatgatcagccacactggaactgagacacggtccagactcctacgggaggcagcagtggggaatattggacaatgggcgcaagcctgatccagccataccgcgtgggtgaagaaggccttcgggttgtaaagcccttttgttgggaaagaaatccagctggctaatacccggttgggatgacggtacccaaagaataagcaccggctaacttcgtgccagcagccgcggtaatacgaagggtgcaagcgttactcggaattactgggcgtaaagcgtgcgtaggtggtcgtttaagtccgttgtgaaagccctgggctcaacctgggaactgcagtggatactgggcgactagaatgtggtagagggtagcggaattcctggtgtagcagtgaaatgcgtagagatcaggaggaacatccatggcgaaggcagctacctggaccaacattgacactgaggcacgaaagcgtggggagcaaacaggattagataccctggtagtccacgccctaaacgatgcgaactggatgttgggtgcaatttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggccttgacatgtcgagaactttccagagatggatgggtgccttcgggaactcgaacacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacggccagggctacacacgtactacaatggtagggacagagggctgcaagccggcgacggtaagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgcttgccacggtgtnnnngatgactggggtgaagtcgtaacaaggtagccgtatcggaaggtgcggctggatcac

SEQ ID NO: 1165 - DNA, 1452 bp, Flavisolibacter ginsengiterrae
tgaacgctggcggcaggcctaacacatgcaagtcgagcggtagcacagagagcttgctctcgggtgacgagcggcggacgggtgagtaatgtctgggaaactgcctgatggagggggataactactggaaacggtagctaataccgcataacgtcgcaagaccaaagtgggggaccttcgggcctcatgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcggggaggaaggcgataaggttaataaccttgtcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctggtcttgacatccacagaacttagcagagatgctttggtgccttcgggaactgtgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgaccagggctacacacgtgctacaatggcatatacaaagagaagcgacctcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatga

SEQ ID NO: 1166 - DNA, 1459 bp, Chryseobacterium sp.; identical to SEQ ID NO: 1135
  modified_base (128)..(129): a, c, t or g
  modified_base (173)..(173): a, c, t or g

SEQ ID NO: 1167 - DNA, 1498 bp, Arthrobacter nitroguaiacolicus
agagtttgatcctggctcagattgaacgctggcggaatgctttacacatgcaagtcgaacgatgaaccttagcttgctaaggggattagtggcgaacgggtgagtaatatatcggaacgtgccttgtaatgggggataactagtcgaaagattagctaataccgcatacgccctgagggggaaagtaggggatcttcggaccttacgttataagagcggccgatatctgattagctagttggtggggtaatggcctaccaaggcttcgatcagtagctggtctgagaggacgaccagccacactggaactgagacacggtccagactcctacgggaggcagcagtggggaattttggacaatgggcgcaagcctgatccagccattccgcgtgagtgaagaaggccttcgggttgtaaagctctttcgcaagggaagaaaacttacattctaataaagtgtgaggctgacggtaccttgataagaagcaccggctaactacgtgccagcagccgcggtaatacgtagggtgcgagcgttaatcggaattactgggcgtaaagcgtgcgcaggcggttttgtaagtcagatgtgaaatccccgagctcaacttgggaactgcgtttgaaactacaagactagaatatgtcagaggggggtagaattccacgtgtagcagtgaaatgcgtagagatgtggaggaataccaatggcgaaggcagccccctgggataatattgacgctcatgcacgaaagcgtggggagcaaacaggattagataccctggtagtccacgccctaaacgatgtctactagttgttggtggagtaaaatccatgagtaacgcagctaacgcgtgaagtagaccgcctggggagtacggtcgcaagattaaactcaaaggaattgacgggggcccgcacaagcggtggattatgtggattaattcgatgcaacgcgaaaaccttacctggccttgacatgccactaacgaagcagagatgcattaggtgcccgtaagggaaagtggacacaggtgctgcatggctgtcgtcagctcgtgtcgtgagatgttgggttaagtcccgcaacgagcgcaacccttgccattaattgccatcatttagttgggcactttaatgggactgccggtgacaaaccggaggaaggtggggatgacgtcaagtcctcatggcccttatggccagggcttcacacgtaatacaatggtcggtacagagagttgccaacccgcgagggggagctaatctcagaaagccgatcgtagtccggattgttctctgcaactcgagagcatgaagtcggaatcgctagtaatcgcggatcagcatgtcgcggtgaatacgttcccgggccttgtacacaccgcccgtcacaccatgggagtgggttttaccagaagtagttagtctaaccgtaagggggacgattaccacggtagtattcatgactggggtgaagtcgtaacaaggtaacc

SEQ ID NO: 1168 - DNA, 1438 bp, Burkholderia gladioli
gaacgctggcggcatgctttacacatgcaagtcgaacggcagcacgggcttcggcctggtggcgagtggcgaacgggtgagtaatatatcggaacgtacccagaagtgggggataacgtagcgaaagttacgctaataccgcatacgatctacggatgaaagtgggggaccttcgggcctcatgcttgtggagcggccgatatctgattagctagtaggtagggtaaaggcctacctaggcgacgatcagtagctggtctgagaggacgaccagccacactgggactgagacacggcccagactcctacgggaggcagcagtggggaattttggacaatgggcgcaagcctgatccagcaatgccgcgtgagtgaagaaggccttcgggttgtaaagctcttttgtcagggaagaaacggctgaggttaataccttcggctaatgacggtacctgaagaataagcaccggctaactacgtgccagcagccgcggtaatacgtagggtgcaagcgttaatcggaattactgggcgtaaagcgtgcgcaggcggttttgtaagtctgacgtgaaatccccgggctcaacctgggaattgcgttggagactgcaaggctggagtctggcagaggggggtagaattccacgtgtagcagtgaaatgcgtagagatgtggaggaacaccgatggcgaaggcagccccctgggtcaagactgacgctcatgcacgaaagcgtggggagcaaacaggattagataccctggtagtccacgccctaaacgatgtctactagttgtcgggttttaattaacttggtaacgcagctaacgcgtgaagtagaccgcctggggagtacggtcgcaagattaaaactcaaaggaattgacggggacccgcacaagcggtggatgatgtggattaattcgatgcaacgcgaaaaaccttacctacccttgacatggaaggaatcccgaagagatttgggagtgcccgaaagggagccttcacacaggtgctgcatggctgtcgtcagctcgtgtcgtgagatgttgggttaagtcccgcaacgagcgcaacccttgtcattagttgctacgcaagagcactctaatgagactgccggtgacaaaccggaggaaggtggggatgacgtcaagtcctcatggcccttatgggtagggcttcacacgtcatacaatggtacatacagagggccgccaacccgcgagggggagctaatcccagaaagtgtatcgtagtccggattgtagtctgcaactcgactacatgaagttggaatcgctagtaatcgcggatcagcatgtcgcggtgaatacgttcccgggtcttgtacacaccgcccgtcacaccatgggagcgggttttaccagaagtaggtagcttaaccgcaaggagggcgcttaccacggtaggattc

SEQ ID NO: 1169 - DNA, 1423 bp, Burkholderia plantarii
  modified_base (406)..(406): a, c, t or g
acacatgcaagtcgaacggtaacagagagcagcttgctgctctgctgacgagtggcggacgggtgagtaatgtctgggaaactgcctgatggagggggataactactggaaacggtagctaataccgcataacgtcttcggaccaaagtgggggaccttcgggcctcatgccatcagatgtgcccagatgggattagctagtaggtggggtaaaggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcgaggaggaagggnttgtggttaataaccgcagtcattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatttgaaactggcaagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccagagaatcctgcagagatgcgggagtgccttcgggaactctgagacaggtgctgcatggctgtcgtcagctcgtgttgtgaaatgttgggttaagtcccgcaacgagcgcaacccttatcctttgttgccagcacgtaatggtgggaactcaaaggagactgccggtgataaaccggaggaaggtggggatgacgtcaagtcatcatggcccttacgaccagggctacacacgtgctacaatggcgcatacaaagagaagcgaactcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccacttt

SEQ ID NO: 1170 - DNA, 1387 bp, Pantoea dispersa
caggcttaacacatgcaagtcgagcgccccgcaaggggagcggcagacgggtgagtaacgcgtgggaatctaccttttgctacggaataactcagggaaacttgtgctaataccgtatgtgcccttcgggggaaagatttatcggcaaaggatgagcccgcgttggattagctagttggtggggtaaaggcccaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccagagctcaactctggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgtcggggtgtttacacttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcctttagttgccatcatttagttgggcactctaaagggactgccagtgataagctggaggaaggtggggatgacgtcaagtcctcatggcccttacgggctgggctacacacgtgctacaatggtggtgacagtgggcagcaagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttctgcccgaaggcactgtgctaaccgtaaggaggcaggtgaccacggtagggtcagcgactgggg

SEQ ID NO: 1171 - DNA, 1513 bp, Pandoraea sputorum
gacgaacgctggcggcgtgcctaatacatgcaagtcgagcggggttatgttagaagcttgcttctaacataacctagcggcggacgggtgagtaacacgtaggcaacctgcccatgagactgggataactaccggaaacggtagctaataccggatacatcctttccctgcatggggagaggaggaaagacggagcaatctgtcactgatggatgggcctgcggcgcattagctagttggtggggtcaaggcctaccaaggcgacgatgcgtagccgacctgagagggtgatcggccacactgggactgagacacggcccagactcctacgggaggcagcagtagggaatcttccgcaatgggcgaaagcctgacggagcaacgccgcgtgagtgatgaaggttttcggatcgtaaagctctgttgccagggaagaacgtcttgtagagtaactgctacaagagtgacggtacctgagaagaaagccccggctaactacgtgccagcagccgcggtaatacgtagggggcaagcgttgtccggaattattgggcgtaaagcgcgcgcaggcggctctttaagtctggtgtttaatcccgaggctcaacttcgggtcgcactggaaactggggagcttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaggtcttgacatccccctgaccggtctagagatagacctttccttcgggacaggggagacaggtggtgcatggttgtcgtcagctcgtgtcgtgagatgttgggttaagtcccgcaacgagcgcaacccttatgcttagttgccagcaggtcaagctgggcactctaagcagactgccggtgacaaaccggaggaaggtggggatgacgtcaaatcatcatgccccttatgacctgggctacacacgtactacaatggccggtacaacgggaagcgaaagagcgatctggagcgaatcctagaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaacccgcaagggagccagccgccgaaggtggggtagatgattggggtgaagtcgtaacaaggtagccgtatcggaaggtgc

SEQ ID NO: 1172 - DNA, 1531 bp, Pantoea agglomerans
gagtttgatcctggctcaggacgaacgctggcggcgtgcctaatacatgcaagtcgagcggacagaagggagcttgctcccggatgttagcggcggacgggtgagtaacacgtgggtaacctgcctgtaagactgggataactccgggaaaccggagctaataccggatagttccttgaaccgcatggttcaaggatgaaagacggtttcggctgtcacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgcaagagtaactgcttgcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaaccctagagatagggctttcccttcggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggctgcgagaccgcaaggtttagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgcaacacccgaagtcggtgaggtaacctttatggagccagccgccgaaaggtggggcagatgattggggtgaagtcgtaacaaggtagccgtatcggaaggtgcggctgga

SEQ ID NO: 1173 - DNA, 1295 bp, Limnobacter thiooxidans
tcggggaacggcgggaactgccggtataccccatggtatcacattttggcatcattatgtgattaaagtaaagccccttggatcggtgtgcgttcattatagttggcggggtaacggcccaccaaggtccgatcgatagggggtgtgagagcatggccccccacacgggtactgagacacggacccgactcctacgggaggcagcagtaaggaatattggacaatgggcggaagcctgatccaccatgccgcgtgaaggacgaaggcgctcagcgttgtaaacttcttttggatgggaacaataatcgagacttgtcttgacttgagggtaccatcagaataagcaccggctaactccgtgccagcagccgcggtaatacggagggtgcaagcgttatccggaatcactgggtttaaagggtgcgtaggcggcccataggtcagtcgtgaaatcgctgggctcaacccatgcaattgcgattgatactgttggacttgaattaggttgaggctggcggaatgcgacatgtagcggtgaaatgcttagatatgtcgcagaacaccgattgcgaaggcagccagctgggcctttattgacgctgaggcacgaaagcgtggggagcaaacaggattagataccctggtagtccacgccctaaacgatgctcacttgctgttcctctttcggggggagtggcgtagggaaaccggtaagtgagccacctggggagtacgcccgcaagggtgaaactcaaaggaattgacgggggtccgcacaagcggtggagcatgtggtttaattcgatgatacgcgaggaaccttacctgggctagaatgcatttggaatatggatgaaagttcatagcctttcggggccacttgcaaggtgctgcatggctgtcgtcagctcgtgtcgtgagatgttgggttaagtcccgcaacgagcgcaacccccgtgtccagttgccagcattaagttggggactctggacagactgccgccgcaaggtgtgaggaaggtggggacgacgtcaagtcatcatggcctttatgcccagggctacacacgtgctacaatggggtgaacagagggcagctaccgcgcgagcggatgcgaatctcagaaaacaccccccagttcggattggagtctgcaacccgactccatgaaggtggaatcgctagtaatcgcgcatcagccatggcgcggtgaatacgttcccggaccttgtacacaccgcccgtcaaccatgggagcttggggccctaagacggtctttgatgactcaaacat

SEQ ID NO: 1174 - DNA, 1452 bp, Enterobacter cancerogenus
tgaacgctggcggcaggcctaacacatgcaagtcgagcggtagcacagagagcttgctctcgggtgacgagcggcggacgggtgagtaatgtctgggaaactgcctgatggagggggataactactggaaacggtagctaataccgcataacgtcgcaagaccaaagtgggggaccttcgggcctcatgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagyggggaggaaggcgwtaaggttaataaccttgkcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggcttaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctggtcttgacatccacagaactttccagagatggattggtgccttcgggaactgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcatatacaaagagaagcgacctcgcgagagcaagcggacctcataaagtatgtcgtagtccggattggagtctgcaactygactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatga

SEQ ID NO: 1175 - DNA, 1452 bp, Pseudomonas hibiscicola; identical to SEQ ID NO: 1165

SEQ ID NO: 1176 - DNA, 1432 bp, Klebsiella pneumoniae
cttgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaatggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataacctygccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctygtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacc

SEQ ID NO: 1177 - DNA, 1348 bp, Acinetobacter radioresistens
  modified_base (354)..(354): a, c, t or g
ggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaatggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgnggttaataacctcatcgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcgcgtgatggcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcg

SEQ ID NO: 1178 - DNA, 1473 bp, Methylophilus methylotrophus; identical to SEQ ID NO: 1149

SEQ ID NO: 1179 - DNA, 1495 bp, Massilia sp.; identical to SEQ ID NO: 1163

SEQ ID NO: 1180 - DNA, 1459 bp, Cronobacter turicensis
attgaacgctggcggcaggcctaacacatgcaagtcgagcggatgagaggagcttgctcctcgattcagcggcggacgggtgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccttcgggtcgtaaagcactttaagttgggaggaagggctcatagcgaatacctgtgagttttgacgttaccaacagaataagcaccggctaacttcgtgccagcagccgcggtaatacgaagggtgcaagcgttaatcggaattactgggcgtaaagcgcgcgtaggtggcttgataagttggatgtgaaatccccgggctcaacctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccttcgggaggacggttaccacggagtgattcatgactggggtg

SEQ ID NO: 1181 - DNA, 1494 bp, Ochrobactrum pseudogrignonense
gcggcaggcctaacacatgcaagtcgagcggaaacgacactaacaatccttcgggtgcgttaatgggcgtcgagcggcggacgggtgagtaatgcctaggaaattgccttgatgtgggggataaccattggaaacgatggctaataccgcatratgcctacgggccaaagagggggaccttcgggcctctcgcgtcaagatatgcctaggtgggattagctagttggtgaggtaatggctcaccaaggcgacgatccctagctggtctgagaggatgatcagccacactggaactgagacacggtccagactcctacgggaggcagcagtggggaatattgcacaatgggcgcaagcctgatgcagccatgccgcgtgtatgaagaaggccttcgggttgtaaagtactttcagttgtgaggaagggggtgttgttaatagcwrcatmtcttgacgttagcaacagaagaagcaccggctaactccgtgccagcagccgcggtaatacggagggtgcgagcgttaatcggaattactgggcgtaaagcgcatgcaggtggttcattaagtcagatgtgaaagcccggggctcaacctcggaactgcatttgaaactggtgaactagagtrctgtagaggggggtagaatttcaggtgtagcggtgaaatgcgtagagatctgaaggaataccagtggcgaaggcggccccctggacagatactgacactcagatgcgaaagcgtggggagcaaacaggattagataccctggtagtccacgccgtaaacgatgtctacttggaggttgtggccttgagccgtggctttcggagctaacgcgttaagtagaccgcctggggagtacggtcgcaagattaaaactcaaatgaattgacgggggcccgcacaagcggtggagcatgtggtttaattcgatgcaacgcgaagaaccttacctactcttgacatccagagaatccagcggagacgcaggagtgccttcgggagctctgagacaggtgctgcatggctgtcgtcagctcgtgttgtgaaatgttgggttaagtcccgcaacgagcgcaacccttatccttgtttgccagcgagtcatgtcgggaactccagggagactgccggtgataaaccggaggaaggtggggacgacgtcaagtcatcatggcccttacgagtagggctacacacgtgctacaatggcgcatacagagggcagcgagccagcgatggtaagcgaatcccaaaaagtgcgtcgtagtccggattggagtctgcaactcgactccatgaagtcggaatcgctagtaatcgtgaatcagaatgtcacggtgaatacgttcccgggccttgtacacaccgcccgtcacaccatgggagtgggctgcaaaagaagtaggtagtctaaccttcgggaggacgcttaccactttgtggttcatgactggggtgaagtcgtaacaaggtagccctaggggaacc

SEQ ID NO: 1182 - DNA, 1511 bp, Paenibacillus taejonensis
attgracgctggcggcaggcctaacacatgcaagtcgagcggaaacggcagtattgaagcttcggtggatttactggacgtcgagcggcggacgggtgagtaacggctgggaaccttccctgacgrgggggataaccgttggaaacgacggctaataccgcataatgtcytagatcattamgagctgggaccaaaggtggcctctacatgtaagctatcgcgttgggatgggcccagttaggattagctagttggtaaggtaatggcttaccaaggcaacgatccttagctggtttgagaggatgatcagccacactgggactgagacacggcccagactcctacgggaggcagcagtggggaatattgcacaatgggggagaccctgatgcagccatgccgcgtgtgtgaagaaggccttcgggttgtaaagcactttcagcagtgaggaaggtcgtgtacttaatacgtgcacggcttgacgttagctgcagaagaagcaccggctaactccgtgccagcagccgcggtaatacggagggtgcgagcgttaatcggaattactgggcgtaaagcgcatgcaggcggtttgttaagtcagatgtgaaagcccggggctcaacctcggaaccgcatttgaaactggcaggctagagtcttgtagaggggggtagaatttcaggtgtagcggtgaaatgcgtagagatctgaaggaataccagtggcgaaggcggccccctggacaaagactgacgctcagatgcgaaagcgtgggtagcaaacaggattagataccctggtagtccacgccgtaaacgctgtctacttggaggttgaggttttagactttggctttcggcgctaacgcattaagtagaccgcctggggagtacggccgcaaggttaaaactcaaatgaattgacgggggcccgcacaagcggtggagcatgtggtttaattcgatgcaacgcgaagaaccttacctactcttgacatccagcgaagcctttagagatagaggtgtgccttcgggagcgctgagacaggtgctgcatggctgtcgtcagctcgtgttgtgaaatgttgggttaagtcccgcaacgagcgcaacccttatccttgtttgccagcacataatggtgggaactccagggagactgccggtgataaaccggaggaaggtggggacgacgtcaagtcatcatggcccttacgagtagggctacacacgtgctacaatggcagatacagagggcagcgagacagcgatgtttagcgaatcccttaaagtttgtcgtagtccggattggagtctgcaactcgactccatgaagtcggaatcgctagtaatcgtggatcagaatgccacggtgaatacgttcccgggccttgtacacaccgcccgtcacaccatgggagtgggctgcaccagaagtagatagcttaaccttcgggagggcgtttaccacggtgtggttcatgactggggtgaagtcgtaacaaggtaccc

SEQ ID NO: 1183 - DNA, 1496 bp, Bacillus stratosphericus
gtttgatcctggctcagattgaacgctggcggaatgctttacacatgcaagtcgagcggcagcgcggggcaacctggcggcgagcggcgaacgggtgagtaatacatcggaacgtacccaatcgtgggggataacacatcgaaagatgtgctaataccgcataagtcctgagggagaaagcgggggatcgcaagacctcgcgcggatggagcggccgatggcggattagctagttggtggggtaaaggcctaccaaggcgacgatccgtagctggtctgagaggacgaccagccacactggaactgagacacggtccagactcctacgggaggcagcagtggggaattttggacaatgggcgcaagcctgatccagccattccgcgtgagtgaagaaggccttcgggttgtaaagctctttcggcagggaagaaacggtttgggctaataccccgagctaatgacggtacctgaagaagaagcaccggctaactacgtgccagcagccgcggtaatacgtagggtgcgagcgttaatcggaattactgggcgtaaagcgtgcgcaggcggttttgtaagacagatgtgaaatccccgggcttaacctgggaactgcgtttgtgactgcaagactcgagtacggcagaggggggtggaattccacgtgtagcagtgaaatgcgtagagatgtggaggaacaccgatggcgaaggcagccccctgggtcgatactgacgctcatgcacgaaagcgtggggagcaaacaggattagataccctggtagtccacgccctaaacgatgccaactaggtgttggggaaggagacttccttagtaccgtagctaacgcgtgaagttggccgcctggggagtacggtcgcaagattaaaactcaaaggaattgacggggacccgcacaagcggtggatgatgtggattaattcgatgcaacgcgaaaaaccttacctacccttgacatgccaggaactttccagagatggattggtgctcgaaagagagcctggacacaggtgctgcatggctgtcgtcagctcgtgtcgtgagatgttgggttaagtcccgcaacgagcgcaacccttgtcattagttgccatcatttagttgggcactctaatgagactgccggtgacaaaccggaggaaggtggggatgacgtcaagtcctcatggcccttatgggtagggcttcacacgtcatacaatggtcggtacagagggttgccaacccgcgagggggagccaatcccaataaagccgatcgtagtccggatcggagtctgcaactcgactccgtgaagtcggaatcgctagtaatcgcggatcagcatgccgcggtgaatacgttcccgggtcttgtacacaccgcccgtcacaccatgggagtgggtttcaccagaagtaggtagtctaaccgcaaggagggcgcttaccacggtgggattcatgactggggtgaagtcgtaacaaggtagccg

SEQ ID NO: 1184 - DNA, 1407 bp, Unknown
  source: /note="Description of Unknown: Uncultured Saprospiraceae bacterium"
gctcagattgaacgctggcggcgtgcctaacacatgcaagtcgagcggtaacaggtgtagcaatacatgctgacgagcggcggacgggtgagtaacgcttgggaatctgcctattagtgggggataactcggggaaactcgagctaataccgcatacgcactacggtggaaagctggggaccgcaaggcctggcgctaatagatgagcccaagtcggattagctagttggtagggtaatggcctaccaaggcgacgatccgtaactggtctgagaggacgaccagtcacaccggaactgagacacggtccggactcctacgggaggcagcagtggggaatattggacaatgggcgaaagcctgatccagcgacgccgcgtgggtgaagaaggcctgcgggttgtaaagccctttcagtggggaagaaaagcctcgagtgaatacctcggggtcttgacgtaacccatagaagaagcaccggctaactctgtgccagcagccgcggtaatacagagggtgcgagcgttaatcggaattactgggcgtaaagcgcgcgtaggcggctttgcaagtcggatgtgaaatccccgggctcaacctgggaactgcattcgagactgcattgctagagtatgggagagggaagtggaatttcaggtgtagcggtgaaatgcgtagatatctgaaggaacatcagtggcgaaagcgacttcctggaccaatactgacgctcatgtgcgaaagcgtggggagcaaacaggattagataccctggtagtccacgccataaacgatgagaactggatgtcgggagggttctgcctctcggtgtcgtagctaacgcgttaagttctccgcctggggagtacggccgcaaggttgaaactcaaaggaattgacggggacccgcacaagcggtggagcatgtggtttaattcgatgcaacgcgaagaaccttacctggtcttgacatcccaggaatcctgcagagatgcgggagtgccttcgggaacctggagacaggtgctgcatggctgtcgtcagctcgtgtcgtgagatgttgggttaagtcccgcaacgagcgcaacccttgcccttagttgccagcattcagttgggaactctaaggggaccgccggtgacaaaccggaggaaggtggggatgacgtcaagtcatcatggcccttatgaccagggctacacacgtgctacaatggccagtacaaagggttgccaacccgcgagggggagctaatcccataaagctggtcgtagtccggatcgcagtctgcaactcggctgcgtgaagtcggaatcgctagtaatcgtgaatcagcattgtcacggtgaatacgttcccgggtcttgtacacaccgcccgtcacaccatgggagttgattgcacca

SEQ ID NO: 1185 - DNA, 1452 bp, Klebsiella pneumoniae
ttgatcctggctcagattgaacgctggcggcatgctttacacatgcaagtcgaacggcagcgggcccttcggggtgccggcgagtggcgaacgggtgagtaatgcatcggaacgtacccaggagtgggggataaccagtcgaaagattggctaataccgcatacgtcctgagggggaaagcgggggaccgtaaggcctcgcgctcttggagcggccgatgtccgattagctagttggtggggtaaaggcctaccaaggcgacgatcggtagctggtctgagaggatgatcagccacactggaactgagacacggtccagactcctacgggaggcagcagtggggaattttggacaatgggggaaaccctgatccagccatgccgcgtgagtgaagaaggccttcgggttgtaaagctctttcggacgggaagaaatcgccctggctaatatctggggtggatgacggtaccgtaagaagaagcaccggctaactacgtgccagcagccgcggtaatacgtagggtgcgagcgttaatcggaattactgggcgtaaagcgtgcgcaggcggctcattaagacaggcgtgaaatccccgggcttaacctgggaactgcgcttgtgactggtgggctagagtgtgtcagagggaggtggaattccacgtgtagcagtgaaatgcgtagagatgtggaggaacaccgatggcgaaggcagcctcctgggataacactgacgctcatgcacgaaagcgtggggagcaaacaggattagataccctggtagtccacgccctaaacgatgtcgactagtcgttggtggagaaatccattagtgacgcagctaacgcgtgaagtcgaccgcctggggagtacggccgcaaggttaaaactcaaaggaattgacgggggcccgcacaagcggtggatgatgtggattaattcgatgcaacgcgaaaaaccttacctacccttgacatggcaggaatcctccagagatgggggagtgcccgaaagggaacctgcacacaggtgctgcatggctgtcgtcagctcgtgtcgtgagatgttgggttaagtcccgcaacgagcgcaacccttgccattagttgctacatttggttgggcactctaatgggactgccggtgacaaaccggaggaaggtggggatgacgtcaagtcctcatggcccttatgggtagggcttcacacgtcatacaatggtcggtacagagggtcgccaacccgcgagggggagccaatcccagaaagccgatcgtagtccggattgcagtctgcaactcgactgcatgaagtcggaatcgctagtaatcgcggatcagcatgtcgcggtgaatacgttcccgggccttgtacacaccgcccgtcacaccatgggagtgggtttcaccagaagtgggtagcctaaccgcaaggggggcgcttaccacgg

SEQ ID NO: 1186 - DNA, 1477 bp, Klebsiella pneumoniae
aggatgaacgctggcggcgtgcctaatacatgcaagtcgagcgaacagataaggagcttgctcctttgacgttagcggcggacgggtgagtaacacgtgggtaacctacctataagactggaataactccgggaaaccggggctaatgccggataacatttagaaccgcatggttctaaagtgaaagatggttttgctatcacttatagatggacccgcgccgtattagctagttggtaaggtaacggcttaccaaggcaacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacaaatgtgtaagtaactatgcacgtcttgacggtacctaatcagaaagccacggctaactacgtgccagcagccgcggtaatacgtaggtggcaagcgttatccggaattattgggcgtaaagcgcgcgtaggcggtttcttaagtctgatgtgaaagcccacggctcaaccgtggagggtcattggaaactgggaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgacaactctagagatagagccttccccttcgggggacaaagtgacaggtggtgcatggttgtcgtcagctcgtgtcgtgagatgttgggttaagtcccgcaacgagcgcaacccttaaacttagttgccagcatttagttgggcactctaagttgactgccggtgacaaaccggaggaaggtggggatgacgtcaaatcatcatgccccttatgatttgggctacacacgtgctacaatggacaatacaaagggcagctaaaccgcgaggtcatgcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccatttatggagctagccgtcgaaggtgggacaaatgattggggtg

SEQ ID NO: 1187 - DNA, 1544 bp, Pantoea anthophila
  modified_base (11)..(12): a, c, t or g
agagtttgatnntggctcaggatgaacgctggcggcgtgcctaatacatgcaagtcgagcgaacagacgaggagcttgctcctttgacgttagcggcggacgggtgagtaacacgtgggtaacctacctataagactgggataacttcgggaaaccggagctaataccggataatatttcgaaccgcatggttcgatagtgaaagatggctttgctatcacttatagatggacctgcgccgtattagctagttggtaaggtaacggcttaccaaggcaacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacaaacgtgtaagtaactgtgcacgtcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctctaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgacccttctagagatagaagtttccttcgggggacaaagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacaatacaaagggcagcgaaaccgcgaggtcaagcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccatttggagctagccgtcgaaggtgggacaaatgattggggtgaagtcgtaacaaggtagccgtatcggaaggtgcggctggatcacctcctttct

SEQ ID NO: 1188 - DNA, 1467 bp, Pantoea eucalypti
cagagtttgatctggctcaggacgaacgctggcggcgtgcttaacacatgcaagtcgaacgatgaagactggtgcttgcactggttggattagtggcgaacgggtgagtaatacgtgagtaacctgcctttgactctgggataagcctgggaaactgggtctaataccggatatgacaaggaaccgcatggttttttgtggaaagggtttgtactggttttagatgggctcacggcctatcagcttgttggtggggtaatggctcaccaaggcgacgacgggtagccggcctgagagggtgaccggccacactgggactgagacacggcccagactcctacgggaggcagcagtggggaatattgcacaatgggcgcaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcgagcgttgtccggaattattgggcgtaaagagcttgtaggcggtttgttgcgtctgctgtgaaagaccggggcttaaccccggtattgcagtgggtacgggcagactagagtgcagtaggggagactggaattcctggtgtagcggtgaaatgcgcagatatcaggaggaacaccgatggcgaaggcaggtctctgggctgtaactgacgctgagaagcgaaagcatggggagcgaacaggattagataccctggtagtccatgccgtaaacgttgggcactaggtgtgggggacattccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatatactggaccgcctcagagatggggtttcccttcggggctggtatacaggtggtgcatggttgtcgtcagctcgtgtcgtgagatgtcagctcgtgtcgtgagatgttgggttaagtcccgcaacgagcgcaaccctcgttctatgttgccagcacgttgtggtggggactcataggagactgccggggtcaactcggaggaaggtggggatgacgtcaaatcatcatgccccttatgtcttgggcttcacgcatgctacaatggccggtacaaagggttgcgatactgtgaggttgagctaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagttggtaacacccgaagccgatggcctaaccccttgtgggagggagtcgt

SEQ ID NO: 1189 - DNA, 1532 bp, Pantoea agglomerans
gagagtttgatcctggctcagattgaacgctggcggcaggcttaacacatgcaagtcgagcggtagcacaggggagcttgctccctgggtgacgagcggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcgaggaggaaggtggtgaacttaatacgctcatcaattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatttgaaactggcaagctagagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgctgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcgtatacaaagagaagcgacctcgcgagagcaagcggacctcataaagtacgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggctggatcacctc

SEQ ID NO: 1190 - DNA, 1508 bp, Enterobacter cancerogenus; identical to SEQ ID NO: 1131
  modified_base (13)..(14): a, c, t or g
  modified_base (811)..(813): a, c, t or g
  modified_base (1102)..(1102): a, c, t or g

SEQ ID NO: 1191 - DNA, 1466 bp, Pseudomonas sp.
cctaacacatgcaagtcgagcggatgagaggagcttgctcttcgattcagcggcggacgggtgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccttcgggtcgtaaagcactttaagttgggaggaagggctcatagcgaatacctgtgagttttgacgttaccaacagaataagcaccggctaacttcgtgccagcagccgcggtaatacgaagggtgcaagcgttaatcggaattactgggcgtaaagcgcgcgtaggtggcttgataagttggatgtgaaatccccgggctcaacctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccctcgggaggacggttaccacggagtgattcatgactggggtgaagtcgtaacaaggtagccgtagggg

SEQ ID NO: 1192 - DNA, 1519 bp, Vibrio sp.; identical to SEQ ID NO: 1164
  modified_base (273)..(274): a, c, t or g
  modified_base (279)..(279): a, c, t or g
  modified_base (1459)..(1462): a, c, t or g

SEQ ID NO: 1193 - DNA, 1498 bp, Salinivibrio costicola
attgaacgctggcggcaggcctaacacatgcaagtcgagcggtagcacagagagcttgcttcttcagggtgacgagcggcggacgggtgagtaatgtctgggaaactgcctgatggagggggataactactggaaacggtagctaataccgcataacgtcgcaagaccaaagagggggaccttgcggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcgaggaggaaggcattgtggttaataaccacagtgattgacgttactcgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtaragatctggaggaataccggtggcgaaggcggccccctggacaaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacagaatttagcagagatgctttagtgccttcgggaacygtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgagtagggctacacacgtgctacaatggcgtatacaaagagaagcgacctcgcgagagcaagcggacctcataaagtacgtcgtagtccggattggagtctgcaactcgactccatgaagtcggaatcgctagtaatcgtaratcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtagccgtaggggaacctgc

SEQ ID NO: 1194 - DNA, 1437 bp, Georgfuchsia toluolica; identical to SEQ ID NO: 1133

SEQ ID NO: 1195 - DNA, 1527 bp, Steroidobacter denitrificans; identical to SEQ ID NO: 1130
  modified_base (1517)..(1517): a, c, t or g

SEQ ID NO: 1196 - DNA, 1374 bp, Thiobacter subterraneus; identical to SEQ ID NO: 1134

SEQ ID NO: 1197 - DNA, 1466 bp, Staphylococcus  cohnii
ggcggcaggcttaacacatgcaagtcgagcggggaaaggtaccttgctacctgacctagcggcggacgggtgagtaatgcttaggaatctgcctattagtgggggacaacgttccgaaaggaacgctaataccgcatacgccctacgggggaaagcaggggatcttcggaccttgcgctaatagatgagcctaagtcggattagctagttggtggggtaaaggcctaccaaggcgacgatctgtagcgggtctgagaggatgatccgccacactgggactgagacacggcccagactcctacgggaggcagcagtggggaatattggacaatgggcggaagcctgatccagccatgccgcgtgtgtgaagaaggccttttggttgtaaagcactttaagcgaggaggaggctcctttagttaatacctaaagagagtggacgttactcgcagaataagcaccggctaactctgtgccagcagccgcggtaatacagagggtgcgagcgttaatcggatttactgggcgtaaagcgtgcgtaggcggctttttaagtcggatgtgaaatccctgagcttaacttaggaattgcattcgatactggaaagctagagtatgggagaggatggtagaattccaggtgtagcggtgaaatgcgtagagatctggaggaataccgatggcgaaggcagccatctggcctaatactgacgctgaggtacgaaagcatggggagcaaacaggattagataccctggtagtccatgccgtaaacgatgtctactagccgttggggcctttgaggctttagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggccttgacatactaagaactttccagagatggattggtgccttcgggaacttagatacaggtgctgcatggctgtcgtcagctcgtgtcgtgagatgttgggttaagtcccgcaacgagcgcaacccttttccttatttgccatcgggtaatgccgggaactttaaggatactgccagtgacaaactggaggaaggcggggacgacgtcaagtcatcatggcccttacggccagggctacacacgtgctacaatggtcggtacaaagggttgctacctcgcgagaggatgctaatctcaaaaagccgatcgtagtccggatcgcagtctgcaactcgactgcgtgaagtcggaatcgctagtaatcgcggatcagaatgccgcggtgaatacgttcccgggccttgtacacaccgcccgtcacaccatgggagtttgttgcaccagaagtaggtagtctaaccgcaaggaggacgcttaccacggtgtggccgatgactgggacgaagtcgtaacaaggta

SEQ ID NO: 1198 - DNA, 1460 bp, Staphylococcus hominis; identical to SEQ ID NO: 1138
  modified_base (1416)..(1416): a, c, t or g

SEQ ID NO: 1199 - DNA, 1462 bp, Rothia amarae; identical to SEQ ID NO: 1140

SEQ ID NO: 1200 - DNA, 1484 bp, Serratia marcescens; identical to SEQ ID NO: 1129

SEQ ID NO: 1201 - DNA, 1495 bp, Pseudomonas lanceolata; identical to SEQ ID NO: 1143
  modified_base (668)..(668): a, c, t or g

SEQ ID NO: 1202 - DNA, 1347 bp, Pseudomonas oryzihabitans; identical to SEQ ID NO: 1150

SEQ ID NO: 1203 - DNA, 1516 bp, Pseudomonas hibiscicola
ttgatcctggctcagattgaacgctggcggcaggcctaacacatgcaagtcgagcggtaacaggggaagcttgcttctcgctgacgagcggcggacgggtgagtaatgtatggggatctgcccgatagagggggataactactggaaacggtagctaataccgcataatctctttggagcaaagcaggggaacttcggtccttgcgctatcggatgaacccatatgggattagctagttggtggggtaatggctcaccaaggcgacgatccctagctggtctgagaggatgatcagccacactgggactgagacacggcccagactcctacgggaggcagcagtggggaatattgcacaatgggcgcaagcctgatgcagccatgccgcgtgtatgaagaaggccttagggttgtaaagtactttcagttgggaggaaggcgttgatgctaatatcatcaacgattgacgttaccaacagaagaagcaccggctaactccgtgccagcagccgcggtaatacggagggtgcaagcgttaatcggaattactgggcgtaaagcgcacgcaggcggttgattaagttagatgtgaaatccccgggcttaacctgggaatggcatctaagactggtcagctagagtcttgtagaggggggtagaattccatgtgtagcggtgaaatgcgtagagatgtggaggaataccggtggcgaaggcggccccctggacaaagactgacgctcaggtgcgaaagcgtggggagcaaacaggattagataccctggtagtccacgctgtaaacgatgtcgatttggaggttgttcccttgaggagtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatccagagaatttagcagagatgctttagtgccttcgggaactctgagacaggtgctgcatggctgtcgtcagctcgtgttgtgaaatgttgggttaagtcccgcaacgagcgcaacccttatcctttgttgccagcacgtcatggtgggaactcaaaggagactgccggtgataaaccggaggaaggtggggatgacgtcaagtcatcatggcccttacgagtagggctacacacgtgctacaatggcgtatacaaagagaagcgacctcgcgagagcaagcggaactcataaagtacgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggctg

SEQ ID NO: 1204 - DNA, 1467 bp, Enterobacter nimipressuralis
ggctcagattgaacgctggcggcaggcttaacacatgcaagtcgagcggggacttcggtcctagcggcgaacgggtgaggaatgcttgggaatctgcccagtagcgggggataacgtttcgaaaggagcgctaataccgcatacgccctacgggggaaagggggggatcttcggacctctcactattggatgagcccaagtcggattagctagttggtggggtaaaggcctaccaaggcgacgatccgtagctggtctgagaggatgatcagccacactggaactgagacacggtccagactcctacgggaggcagcagtggggaatattggacaatgggcgaaagcctgatccagccatgccgcgtgtgtgaagaaggccttcgggttgtaaagcactttaagcgaggaggaatggctctgggttaatacccttgagcagtgacgttactcgcagaataagcaccggctaactctgtgccagcagccgcggtaatacagagggtgcaagcgttaatcggaattactgggcgtaaagcgcgcgtaggcggttgcgtaagttggatgtgaaatccccgggctcaacctgggaattgcattcaaaactgcgcggctagagtgtgggagaggaaggtagaattccaggtgtagcggtgaaatgcgtagatatctggaggaataccgatggcgaaggcagccttctggcctaacactgacgctgaggtgcgaaagcatggggagcaaacaggattagataccctggtagtccatgccgtaaacgatgtctactagccgttgggggacttgatcctttagtggcgcagctaacgcattaagtagaccgcctggggagtacggtcgcaagactaaaactcaaatgaattgacgggggcccgcacaagcggtggagcatgtggtttaattcgatgcaacgcgaagaaccttacctggccttgacatgtctggaatcctgcagagatgcgggagtgccttcgggaatcagaacacaggtgctgcatggctgtcgtcagctcgtgtcgtgagatgttgggttaagtcccgcaacgagcgcaacccttgtccttagttgccagcacgtaatggtgggaactctagggagactgccggtgacaaaccggaggaaggcggggacgacgtcaagtcatcatggcccttacggccagggctacacacgtgctacaatggtcggtacaaagggttgctagcccgcgagggtacgccaatctcaaaaagccgatcgtagtccggattggagtctgcaactcgactccatgaagtcggaatcgctagtaatcgcggatcagaatgccgcggtgaatacgttcccgggccttgtacacaccgcccgtcacaccatgggagtttgttgcaccagaagtaggtagcttaaccgcaaggagggcgcttaccacggtgtggccaatgactggggtgaagtcgtacaagg

SEQ ID NO: 1205 - DNA, 1418 bp, Sphingomonas echinoides
agcgaacgctggcggcaggcctaacacatgcaagtcgaacgaactcttcggagttagtggcggacgggtgagtaacacgtgggaacgtgccttttggttcggaataactcagggaaacttgtgctaataccgaatgtgcccttcgggggaaagatttatcgccattagagcggcccgcgtctgattagctagttggtgaggtaaaagctcaccaaggcgacgatcagtagctggtctgagaggatgaccagccacactgggactgagacacggcccagactcctacgggaggcagcagtggggaatcttgcgcaatgggcgaaagcctgacgcagccatgccgcgtgaatgatgaaggtcttaggattgtaaaattctttcaccggggacgataatgacggtacccggagaagaagccccggctaacttcgtgccagcagccgcggtaatacgaagggggctagcgttgctcggaattactgggcgtaaagggcgcgtaggcggatcgttaagtcagaggtgaaatcccagggctcaaccctggaactgcctttgatactggcgatcttgagtatgagagaggtatgtggaactccgagtgtagaggtgaaattcgtagatattcggaagaacaccagtggcgaaggcgacatactggctcattactgacgctgaggcgcgaaagcgtggggagcaaacaggattagataccctggtagtccacgccgtaaacgatgattgctagttgtcgggctgcatgcagttcggtgacgcagctaacgcattaagcaatccgcctggggagtacggtcgcaagattaaaactcaaaggaattgacgggggcccgcacaagcggtggagcatgtggtttaattcgaagcaacgcgcagaaccttaccaccttttgacatgcctggaccgccacggagacgtggctttcccttcggggactaggacacaggtgctgcatggctgtcgtcagctcgtgtcgtgagatgttgggttaagtcccgcaacgagcgcaaccctcgccattagttgccatcatttagttgggaactctaatgggactgccggtgctaagccggaggaaggtggggatgacgtcaagtcctcatggcccttacagggtgggctacacacgtgctacaatggcgactacagagggttaatccttaaaagtcgtctcagttcggattgtcctctgcaactcgagggcatgaagttggaatcgctagtaatcgcggatcagcatgccgcggtgaatacgttcccgggccttgtacacaccgcccgtcacaccatgggagttggttctacccgaaggcggtgcgctaaccagcaatggaggcagccgaccacggtagggtcagcgactggggtgaagtcgtaacaaggtagccgtaggggaacctgc

SEQ ID NO: 1206 - DNA, 1522 bp, Undibacterium sp.; identical to SEQ ID NO: 1146
  modified_base (11)..(12): a, c, t or g

SEQ ID NO: 1207 - DNA, 1475 bp, Acinetobacter beijerinckii; identical to SEQ ID NO: 1139

SEQ ID NO: 1208 - DNA, 1340 bp, Acinetobacter schindleri; identical to SEQ ID NO: 1142

SEQ ID NO: 1209 - DNA, 1390 bp, Acinetobacter lwoffii
ctggcggcgtgcctaatacatgcaagtcgaacgcttcctaccggtgcttgcaccgggaaagaagagtggcggacgggtgagtaacacgtgggtaacctacctacaagcgggggataacattcggaaacggatgctaataccgcatagatctttttgtctcctggcagaaagaagaaagacggtttcggctgtcacttgtagatggacccgcggcgcattagttagttggtgaggtaatggctcaccaagacgatgatgcgtagccgacctgagagggtgatcggccacactgggactgagacacggcccagactcctacgggaggcagcagtagggaatcttccgcaatggacgaaagtctgacggagcaacgccgcgtgagtgaagaaggttttcggatcgtaaaactctgttgttagagaagaacaaggatgagagtaactgctcgtcccttgacggtatctaaccagaaagccatggctaactacgtgccagcagccgcggtaatacgtagatggcaagcgttgtccggatttattgggcgtaaagcgagcgcaggcggttctttaagtctgatgtgaaagcccctggctcaaccagggagggtcattggaaactggagaacttgagtgcagaagaggaaagtggaattccatgtgtagcggtgaaatgcgtagatatatggaggaacaccagtggcgaaggcgactttctggtctgtaactgacgctgaggctcgaaagcatggggagcaaacaggattagataccctggtagtccatgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagctttcccttcggggacaaagtgacaggtggtgcatggttgtcgtcagctcgtgtcgtgagatgttgggttaagtcccgcaacgagcgcaacccttattattagttgccagcattcagttgggcactctagtgagactgccggtgataaaccggaggaaggtggggatgacgtcaaatcatcatgccccttatgacctgggctacacacgtgctacaatggatggtacaacgagtcgcaaaccgcgaggttaagctaatctcttaaagccattctcagttcggattgtaggctgcaattcgcctacatgaagccggaatcgctagtaatcgcggatcagaacgccgcggtgaatacgaacccgggccttgtacacaccgcccgtcacaccacgag

SEQ ID NO: 1210 - DNA, 1465 bp, Burkholderia ginsengisoli
tgctatacatgcaagtcgagcggaagttgaagagcttgctcttcaactttagcggcggacgggtgagtaacacgtgggcaacctgccctgcagatcgggataactccgggaaaccggtgctaataccgaatagttttgggtccctcctgggacccaacggaaagacggtttcggctgtcactgcaggatgggcccgcggcgcattagctagttggtggggtaacggcccaccaaggccacgatgcgtagccgacctgagagggtgatcggccacactgggactgagacacggcccagactcctacgggaggcagcagtagggaatcttccgcaatggacgcaagtctgacggagcaacgccgcgtgagtgatgaaggttttcggatcgtaaaactctgttgcgagggaagaaaccgtgccagctaactactggcaccttgacggtacctcgccagaaagccacggctaactacgtgccagcagccgcggtaatacgtaggtggcaagcgttgtccggaattattgggcgtaaagcgcgcgcaggcggtcccttaagtctgatgtgaaagcccacggctcaaccgtggagggtcattggaaactgggggacttgagtgcagaagaggaaagtggaattccatgtgtagcggtgaaatgcgtagagatgtggaggaacaccagtggcgaaggcgactttctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcccgctgaccgccttggagacaaggctttcccttcggggacagcggtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacggtacaaagggttgccaacccgcgagggggagccaatcccagaaaaccgttctcagttcggattgcaggctgcaactcgcctgcatgaagccggaatcgctagtaatcgtggatcagcatgccacggtgaatacgttcccgggccttgtacacaccgcccgtcacaccacgagagtttgtaacacccgaagtcggtgaggtaacccttgtggagccagccgccgaaggtgggacagatgattggggtgaagtcgtaacaa

SEQ ID NO: 1211 - DNA, 1423 bp, Curvibacter gracilis; identical to SEQ ID NO: 1169
  modified_base (406)..(406): a, c, t or g

SEQ ID NO: 1212 - DNA, 1459 bp, Achromobacter xylosoxidans; identical to SEQ ID NO: 1135
  modified_base (128)..(129): a, c, t or g
  modified_base (173)..(173): a, c, t or g

SEQ ID NO: 1213 - DNA, 1460 bp, Pantoea dispersa
aacgctggcggcaggcttaacacatgcaagtcgagcggagtgatggtgcttgcactatcacttagcggcggacgggtgagtaatgcttaggaatctgcctattagtgggggacaacatttcgaaaggaatgctaataccgcatacgtcctacgggagaaagcaggggatcttcggaccttgcgctaatagatgagcctaagtcggattagctagttggtggggtaaaggcctaccaaggcgacgatctctagcgggtctgagaggatgatccgccacactgggactgagacacggcccagactcctacgggaggcagcagtggggaatattggacaatgggcgcaagcctgatccagccatgccgcgtgtgtgaagaaggccttatggttgtaaagcactttaagcgaggaggaggctactgaagttaataccttcagatagtggacgttactcgcagaataagcaccggctaactctgtgccagcagccgcggtaatacagagggtgcaagcgttaatcggatttactgggcgtaaagcgcgcgtaggcggctaattaagtcaaatgtgaaatccccgagcttaacttgggaattgcattcgatactggttagctagagtgtgggagaggatggtagaattccaggtgtagcggtgaaatgcgtagagatctggaggaataccgatggcgaaggcagccatctggcctaacactgacgctgaggtgcgaaagcatggggagcaaacaggattagataccctggtagtccatgccgtaaacgatgtctactagccgttggggcctttgaggctttagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggccttgacatagtaagaactttccagagatggattggtgccttcgggaacttacatacaggtgctgcatggctgtcgtcagctcgtgtcgtgagatgttgggttaagtcccgcaacgagcgcaacccttttccttatttgccagcgagtaatgtcgggaactttaaggatactgccagtgacaaactggaggaaggcggggacgacgtcaagtcatcatggcccttacggccagggctacacacgtgctacaatggtcggtacaaagggttgctacctagcgataggatgctaatctcaaaaagccgatcgtagtccggattggagtctgcaactcgactccatgaagtcggaatcgctagtaatcgcggatcagaatgccgcggtgaatacgttcccgggccttgtacacaccgcccgtcacaccatgggagtttgttgcaccagaagtaggtagtctaaccgcaaggaggacgcttaccacggtgtggccgatgactggggtgaagt

SEQ ID NO: 1214 - DNA, 1519 bp, Providencia rustigianii; identical to SEQ ID NO: 1164
  modified_base (273)..(274): a, c, t or g
  modified_base (279)..(279): a, c, t or g
  modified_base (1459)..(1462): a, c, t or g

SEQ ID NO: 1215 - DNA, 1458 bp, Perlucidibaca piscinae
tggctcagattgaacgctggcggcaggcctaacacatgcaagtcgagcggtagagagaagcttgcttctcttgagagcggcggacgggtgagtaatacctaggaatctgcctgatagtgggggataacgttcggaaacggacgctaataccgcatacgtcctacgggagaaagcaggggaccttcgggccttgcgctatcagatgagcctaggtcggattagctagttggtgaggtaatggctcaccaaggctacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcattaacctaatacgttggtgtcttgacgttaccgacagaataagcaccggctaactctgtgccagcagccgcggtaatacagagggtgcaagcgttaatcggaattactgggcgtaaagcgcgcgtaggtggtttgttaagttgaatgtgaaatccccgggctcaacctgggaactgcatccaaaactggcaagctagagtatggtagagggtagtggaatttcctgtgtagcggtgaaatgcgtagatataggaaggaacaccagtggcgaaggcgactacctggactgatactgacactgaggtgcgaaagcgtggggagcaaacaggattagataccctggtagtccacgccgtaaacgatgtcaactagccgttgggagtcttgaactcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttctagagatagattggtgccttcgggaacattgagacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggcctgggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaatgtcacggtgaatacgttcccgggccttgtacacaccgcccgtcacaccatgggagtgggttgcaccagaagtagctagtctaaccttcgggaggacggttaccacggtgtgattcatg

SEQ ID NO: 1216 - DNA, 1522 bp, Brevundimonas sp.; identical to SEQ ID NO: 1146
  modified_base (11)..(12): a, c, t or g

SEQ ID NO: 1217 - DNA, 1495 bp, Limnobacter thiooxidans; identical to SEQ ID NO: 1163

SEQ ID NO: 1218 - DNA, 1481 bp, Rhizobium pisi
agattgaacgctggcggcaggcctaacacatgcaagtcgaacggtagcacagagagcttgctctcgggtgacgagtggcggacgggtgagtaatgtctgggaaactgcctgatggagggggataactactggaaacggtagctaataccgcataatgtcgcaagaccaaagagggggaccttcgggcctcttgccatcagatgtgcccagatgggattagctagtaggcggggtaatggcccacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcggggaggaaggcggtacggttaataaccgtgccgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctggagtctcgtagagggaggtagaattccaggtgtagcggtgaaatgcgtagagatctggaggaataccggtggcgaaggcggcctcctggacgaagactgacgctcaggtgcgaaagcgtggggagcaaacaggattagataccctggtagtccacgccgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctggtcttgacatccacagaacctggcagagatgccggggtgccttcgggaactgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtgaatcagaatgtcacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaa

SEQ ID NO: 1219 - DNA, 1432 bp, Pelomonas puraquae; identical to SEQ ID NO: 1176

SEQ ID NO: 1220 - DNA, 1477 bp, Brevibacterium incertum
aatcctggctcagattgaacgctggcggcatgcctaacacatgcaagtcgaacgagggtagcaataccttagtggcggacgggtgaggaatacataggaatttgcccttaagtgggggatagcccggggaaacccggattaataccgcatgaactcgygagagcaaagtcggggaccttcgggcctggcgcttttggagaagcctatgtcggattagctagttggtgaggtaatggctcaccaaggctgcgatccgtaactggtctgagaggatgatcagtcacaccggaactgagacacggtccggactcctacgggaggcagcagtggggaatattggacaatgggcgaaagcctgatccagcaatgccgcgtgtgtgaagaaggccttcgggttgtaaagcactttaggctggaaagaaaaagctttggctaatatccaaagccttgacggtaccagcagaataagcaccggctaactctgtgccagcagccgcggtaatacagagggtgcaagcgttaatcggatttactgggcgtaaagcgtgcgtaggcggctatttaagtcggatgtgaaagccctgggcttaacctgggaactgcattcgatactgggtagctggagatcggtagagggcggcggaattccgggtgtagcggtgaaatgcgtagatatccggaggaacaccgatggcgaaggcaaccgcctgggcctgatctgacgctgaggcacgaaagcgtggggagcaaacaggattagataccctggtagtccacgctgtaaacgatgagaacttgacgtccgcttgctctgcgagtgggtgtcgaagctaacgcgctaagttctccgcctggggagtacggccgcaaggttgaaactcaaaggaattgacgggggcccgcacaagcggtggagtatgtggtttaattcgatgcaacgcgaagaaccttacctggtcttgacatgtcgagaatcctgcagagatgcgggagtgccttcgggaactcgaacacaggtgctgcatggctgtcgtcagctcgtgtcgtgagatgttgggttaagtcccgcaacgagcgcaacccttgcccttagttgccatcattcagttgggcactctaaggggaccgccggtgacaaaccggaggaaggtggggatgacgtcaagtcatcatggcccttatgaccagggctacacacgtactacaatggtcggtacagagggttgccaacccgcgagggggagctaatcccaaaaagccgatcgtagtccggattggagtctgcaactcgactccatgaagtcggaatcgctagtaatcgcggatcagcacttgtcgcggtgaatacgttcccgggccttgtacacaccgcccgtcacaccatgggagttgtttgcaccagaagtaggtagtctaaccgcaaggggggcgcttaccacggtgtggtcaatgactggggtgaagtcgtaacaaggta

SEQ ID NO: 1221 - DNA, 1452 bp, Planomicrobium glaciei; identical to SEQ ID NO: 1165

SEQ ID NO: 1222 - DNA, 1437 bp, Cronobacter turicensis
aacgaacgctggcggcaggcttaacacatgcaagtcgaacgccccgcaaggggagtggcagacgggtgagtaacgcgtgggaacataccctttcctgcggaatagctccgggaaactggaattaataccgcatacgccctacgggggaaagatttatcggggaaggattggcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctctttcaccggagaagataatgacggtatccggagaagaagccccggctaacttcgtgccagcagccgcggtaatacgaagggggctagcgttgttcggaattactgggcgtaaagcgcacgtaggcggatatttaagtcaggggtgaaatcccagagctcaactctggaactgcctttgatactgggtatcttgagtatggaagaggtaagtggaattccgagtgtagaggtgaaattcgtagatattcggaggaacaccagtggcgaaggcggcttactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagctcttgacattcggggtttgggcagtggagacattgtccttcagttaggctggccccagaacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagacagcgatgtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttttacccgaaggtagtgcgctaaccgcaaggaggcagctaaccacggtagggtcagcgactggggtgaagtcgtaacaaggtagccgtaggggaacc

SEQ ID NO: 1223 - DNA, 1495 bp, Acinetobacter radioresistens; identical to SEQ ID NO: 1143
  modified_base (668)..(668): a, c, t or g

SEQ ID NO: 1224 - DNA, 1434 bp, Acinetobacter calcoaceticus
tgatcctggctcagaacgaacgctggcggcaggcttaacacatgcaagtcgaacgccccgcaaggggagtggcagacgggtgagtaacgcgtgggaacataccctttcctgcggaatagctccgggaaactggaattaataccgcatacgccctacgggggaaagatttatcggggaaggattggcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctctttcaccgatgaagataatgacggtagtcggagaagaagccccggctaacttcgtgccagcagccgcggtaatacgaagggggctagcgttgttcggaattactgggcgtaaagcgcacgtaggcggatatttaagtcaggggtgaaatcccgcagctcaactgcggaactgcctttgatactgggtatcttgagtatggaagaggtaagtggaattccgagtgtagaggtgaaattcgtagatattcggaggaacaccagtggcgaaggcggcttactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagctcttgacattcggggtatgggcattggagacgatgtccttcagttaggctggccccagaacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagacagcgatgtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttttacccgaaggtagtgcgctaaccgcaaggaggcagctaaccacggtagggtcagcgactggggtgaagtcgtaacaag

SEQ ID NO: 1225 - DNA, 1529 bp, Pseudomonas hibiscicola
gtttgatcctggctcagattgaacgctggcggcaggcttaacacatgcaagtcgagcggtaacaggagaagcttgcttctcgctgacgagcggcggacgggtgagtaatacttaggaatctacctagtagtgggggatagcacggggaaactcgtattaataccgcatacgacctacgggagaaagggggcagtttactgctctcgctattagatgagcctaagtcggattagctagatggtggggtaaaggcctaccatggcgacgatctgtagctggtctgagaggatgatcagccacaccgggactgagacacggcccggactcctacgggaggcagcagtggggaatattggacaatgggggaaaccctgatccagccatgccgcgtgtgtgaagaaggccttttggttgtaaagcactttaagcagtgaagaagactccgtggttaatacccacggacgatgacattagctgcagaataagcaccggctaactctgtgccagcagccgcggtaatacagagggtgcaagcgttaatcggaattactgggcgtaaagggagcgtaggtggctcgataagtcagatgtgaaatccccgggcttaacctgggaactgcatctgatactgttgagctagagtatgtgagaggaaggtagaattccaggtgtagcggtgaaatgcgtagagatctggaggaataccgatggcgaaggcagccttctggcataatactgacactgaggctcgaaagcgtgggtagcaaacaggattagataccctggtagtccacgccgtaaacgatgtctactagtcgttgggtcccttgaggacttagtgacgcagctaacgcaataagtagaccgcctggggagtacggccgcaaggttaaaactcaaatgaattgacgggggcccgcacaagcggtggagcatgtggtttaattcgatgcaacgcgaagaaccttacctggtcttgacatatctagaatcctgcagagatgcgggagtgccttcgggaattagaatacaggtgctgcatggctgtcgtcagctcgtgtcgtgagatgttgggttaagtcccgcaacgagcgcaacccttgtccttagttaccagcgggttaagccgggaactctaaggatactgccagtgacaaactggaggaaggcggggacgacgtcaagtcatcatggcccttacgaccagggctacacacgtgctacaatggtaggtacagagggcagctacacagcgatgtgatgcgaatctcaaaaagcctatcgtagtccagattggagtctgcaactcgactccatgaagtaggaatcgctagtaatcgcggatcagaatgccgcggtgaatacgttcccgggccttgtacacaccgcccgtcacaccatgggagttgattgcaccagaagtggatagcttaaccttcgggggagcgttcaccacggtgtggttgatgactggggtgaagtcgtaacaaggtagccgtaggggaacctgcggctggatcacctccttt

SEQ ID NO: 1226 - DNA, 1549 bp, Pseudomonas fragi; identical to SEQ ID NO: 1158

SEQ ID NO: 1227 - DNA, 1403 bp, Limnobacter thiooxidans
cggacgggtgagtaatgtctggggatctgcctgatggagggggataactactggaaacggtagctaataccgcataacgtcgcaagaccaaagagggggaccttcgggcctcttgccatcggatgaacccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcgaggaggaaggcattaaggttaataacctyrgtgattgacgttactcgcagaagaagcaccggctaactccgtgccagcagccgcggtaatacggagggtgcaagcgttaatcggaattactgggcgtaaagcgcacgcaggcggtttgttaagtcggatgtgaaatccccgggctcaacctgggaactgcattcgaaactggcaagcttgagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaccaaggtaa

SEQ ID NO: 1228 - DNA, 1432 bp, Enterobacter cancerogenus; identical to SEQ ID NO: 1176

SEQ ID NO: 1229 - DNA, 1473 bp, Enterobacter oryzae; identical to SEQ ID NO: 1149

SEQ ID NO: 1230 - DNA, 1449 bp, Pantoea anthophila
  modified_base (149)..(149): a, c, t or g
acgctggcggcaggcctaacacatgcaagtcgagcggtagcacagagagcttgctctcgggtgacgagcggcggacgggtgagtaatgtctgggaaactgcctgatggagggggataactactggaaacggtagctaataccgcataangtcgcaagaccaaagagggggaccttcgggcctcttgccatcagatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcgaggaggaaggcattgtggttaataaccacagtgattgacgttactcgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcatatacaaagagaagcgacctcgcgagagcaagcggacctcacaaagtatgtcgtagtccggatcggagtctgcaactcgactccgtgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctttaccactttgtgattcatg

SEQ ID NO: 1231 - DNA, 1532 bp, Hydrocarboniphaga effusa; identical to SEQ ID NO: 1189

SEQ ID NO: 1232 - DNA, 1490 bp, Klebsiella pneumoniae
tagagtttgaatcatggctcagattgaacgctggcggcaggcctaacacatgcaagtcgaacggtaacaggaagcagcttgctgcttcgctgacgagtggcggacgggtgagtaatgtctggggatctgcctgatggagggggataactactggaaacggtagctaataccgcataacgtcgcaagaccaaagagggggaccttcgggcctcttgccatcagatgaacccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgcggttaataaccgcgtcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcatccgaaactggcaggcttgagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacagaactttccagagatggattggtgccttcgggaactgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgaactcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagt

SEQ ID NO: 1233 - DNA, 1407 bp, Agrobacterium radiobacter; identical to SEQ ID NO: 1184

SEQ ID NO: 1234 - DNA, 1459 bp, Achromobacter xylosoxidans
aacgctggcggcaggcttaacacatgcaagtcgagcgggggaaggtagcttgctaccggacctagcggcggacgggtgagtaatgcttaggaatctgcctattagtgggggacaacatctcgaaagggatgctaataccgcatacgtcctacgggagaaagcaggggatcttcggaccttgcgctaatagatgagcctaagtcggattagctagttggtggggtaaaggcctaccaaggcgacgatctgtagcgggtctgagaggatgatccgccacactgggactgagacacggcccagactcctacgggaggcagcagtggggaatattggacaatggggggaaccctgatccagccatgccgcgtgtgtgaagaaggccttatggttgtaaagcactttaagcgaggaggaggctactttagttaatacctagagatagtggacgttactcgcagaataagcaccggctaactctgtgccagcagccgcggtaatacagagggtgcgagcgttaatcggatttactgggcgtaaagcgtgcgtaggcggcttattaagtcggatgtgaaatccccgagcttaacttgggaattgcattcgatactggtgagctagagtatgggagaggatggtagaattccaggtgtagcggtgaaatgcgtagagatctggaggaataccgatggcgaaggcagccatctggcctaatactgacgctgaggtacgaaagcatggggagcaaacaggattagataccctggtagtccatgccgtaaacgatgtctactagccgttggggcctttgaggctttagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggccttgacatactagaaactttccagagatggattggtgccttcgggaatctagatacaggtgctgcatggctgtcgtcagctcgtgtcgtgagatgttgggttaagtcccgcaacgagcgcaacccttttccttacttgccagcatttcggatgggaactttaaggatactgccagtgacaaactggaggaaggcggggacgacgtcaagtcatcatggcccttacggccagggctacacacgtgctacaatggtcggtacaaagggttgctacacagcgatgtgatgctaatctcaaaaagccgatcgtagtccggattggagtctgcaactcgactccatgaagtcggaatcgctagtaatcgcggatcagaatgccgcggtgaatacgttcccgggccttgtacacaccgcccgtcacaccatgggagtttgttgcaccagaagtagctagcctaactgcaaagagggcggttaccacggtgtggccgatgactggggtgaagt

SEQ ID NO: 1235 - DNA, 1459 bp, Candidatus Rhizobium; identical to SEQ ID NO: 1135
  modified_base (128)..(129): a, c, t or g
  modified_base (173)..(173): a, c, t or g

SEQ ID NO: 1236 - DNA, 1484 bp, Psychrobacter urativorans
attgaacgctggcggcaggcttaacacatgcaagtcgaacgatgactctctagcttgctagagatgattagtggcggacgggtgagtaatatttaggaatctgcctagtagtgggggatagctcggggaaactcgaattaataccgcatacgacctacgggtgaaagggggcgcaagmtcttgctattagatgagcctaaatcagattagctagttggtggggtaaaggcccaccaaggcgacgatctgtaactggtctgagaggatgatcagtcacaccggaactgagacacggtccggactcctacgggaggcagcagtggggaatattggacaatgggggcaaccctgatccagccatgccgcgtgtgtgaagaaggccttttggttgtaaagcactttaagcagggaggagaggctaatggttaatacccattagattagacgttacctgcagaataagcaccggctaactctgtgccagcagccgcggtaatacagagggtgcgagcgttaatcggaattactgggcgtaaagcgagtgtaggtggctcattaagtcacatgtgaaatccccgggcttaacctgggaactgcatgtgatactggtggtgctagaatatgtgagagggaagtagaattccaggtgtagcggtgaaatgcgtagagatctggaggaataccgatggcgaaggcagcttcctggcataatattgacactgagattcgaaagcgtgggtagcaaacaggattagataccctggtagtccacgccgtaaacgatgtctactagccgttggggtccttgagactttagtggcgcagttaacgcgataagtagaccgcctggggagtacggccgcaaggttaaaactcaaatgaattgacgggggcccgcacaagcggtggagcatgtggtttaattcgatgcaacgcgaagaaccttacctggtcttgacatagtgagaatctttcagagatgagagagtgccttcgggaattcacatacaggtgctgcatggctgtcgtcagctcgtgtcgtgagatgttgggttaagtcccgcaacgagcgcaacccttttccttatttgccagcgggttaagccgggaactttaaggatactgccagtgacaaactggaggaaggcggggacgacgtcaagtcatcatggcccttacgaccagggctacacacgtgctacaatggtaggtacagagggttgctacacagcgatgtgatgctaatctcaaaaagcctatcgtagtccggattggagtctgcaactcgactccatgaagtcggaatcgctagtaatcgcagatcagaatgctgcggtgaatacgttcccgggccttgtacacaccgcccgtcacaccatgggagtctattgcaccagaagtaggtagcctaacgaaagagggcgcttaccacggtgtggtcgatgactggggtgaagtcgtaacaaggtagccgtaggggaacc

SEQ ID NO: 1237 - DNA, 1513 bp, Burkholderia plantarii; identical to SEQ ID NO: 1171

SEQ ID NO: 1238 - DNA, 1512 bp, Cedecea davisae
tagagtttgatcctggctcaggacgaacgctggcggcgtgcttaacacatgcaagtcgaacggaaaggccctgcttgcagggtactcgagtggcgaacgggtgagtaacacgtgggtgatctgccctgcacttcgggataagcctgggaaactgggtctaataccggataggagccatttttagtgtgatggttggaaagttttttcggtgtaggatgagctcgcggcctatcagcttgttggtggggtaatggcctaccaaggcggcgacgggtagccggcctgagagggtggacggccacattgggactgagatacggcccagactcctacgggaggcagcagtggggaatattgcacaatgggcgcaagcctgatgcagcgacgccgcgtgggggatgacggccttcgggttgtaaactcctttcgctagggacgaagctttttgtgacggtacctagataagaagcaccggctaactacgtgccagcagccgcggtaatacgtagggtgcgagcgttgtccggaattactgggcgtaaagggctcgtaggtggtttgtcgcgtcgtctgtgaaattccggggcttaactccgggcgtgcaggcgatacgggcataacttgagtactgtaggggtaactggaattcctggtgtagcggtgaaatgcgcagatatcaggaggaacaccgatggcgaaggcaggttactgggcagttactgacgctgaggagcgaaagcatgggtagcgaacaggattagataccctggtagtccatgccgtaaacggtgggcgctaggtgtgagggtcttttcacgactttcgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatacaccggatcgggctagagatagtctttccctttgtggctggtgtacaggtggtgcatggttgtcgtcagctcgtgtcgtgagatgttgggttaagtcccgcaacgagcgcaacccttgtcttatgttgccagcatttggttggggactcatgagagactgccggggtcaactcggaggaaggtggggatgacgtcaaatcatcatgccccttatgtccagggcttcacacatgctacaatggtcggtacaacgcgcagcgacactgtgaggtggagcgaatcgctgaaagccggccttagttcggattggggtctgcaactcgaccccatgaagtcggagtcgctagtaatcgcagatcagcaatgctgcggtgaatacgttcccgggccttgtacacaccgcccgtcacgtcatgaaagttggtaacacccgaagccggtggcccaaacttgttagggagccgtcgaaggtgggatcggcgattgggacgaagtcgtaacaaggtacccgtaccggaaggtgcggctggatcacctcctta

SEQ ID NO: 1239 - DNA, 598 bp, Pantoea anthophila
tcttggtcaattagaggaagtaaaagtcgtaacaaggtctccgtaggtgaacctgcggagggatcattacacaataaaatacgaaggccgttcgcggctggactatttattacccttgtcttttgcgcacttgttgtttcctgggcgggcgctcgccaccaggaccacaatataaaccttttttatgcagttgcaatcagcgtcagtacaacaaatgtaaatcatttacaactttcaacaacggatctcttggttctggcatcgatgaagaacgcagcgaaatgcgatacgtagtgtgaattgcagaattcagtgaatcatcgaatctttgaacgcacattgcgccctttggtattccaaagggcatgcctgttcgagcgtcatttgtaccctcaagctttgcttggtgttgggcgtttttgtcccccccaaaaaaggggactcgccttaaaaggattggcagccggcctactggtttcgcagcgcagcacatttttgcgcttgcaatcagcaaaagaggacggcaatccatcaagactccttctcacgtttgacctcggatcaggtagggatacccgctgaacttaagcatatcaat

SEQ ID NO: 1240 - DNA, 562 bp, Pantoea agglomerans
gaggaagtaaaagtcgtaacaaggtttccgtaggtgaacctgcggaaggatcattacctagagttgtaggctttgcctgctatctcttacccatgtcttttgagtacctttcgtttcctcggcgggtccgcccgccgattggacacattcaaaccctttgcagttgcaatcagcgtctgaaaaaacttaatagttacaactttcaacaacggatctcttggttctggcatcgatgaagaacgcagcgaaatgcgataagtagtgtgaattgcagaattcagtgaatcatcgaatctttgaacgcacattgcgccccttggtattccatggggcatgcctgttcgagcgtcatttgtaccttcaagctctgcttggtgttgggtgtttgtctcgcctctgcgcgcagactcgcctcaaaacaattggcagccggcgtattgatttcggagcgcagtacatctcgcgctttgcactcataacgacgacgatccaaaagtacattttttacactcttgacctcggatcaggtagggatacccgctgaacttaagcatatcaataa

SEQ ID NO: 1241 - DNA, 557 bp, Enterobacter amnigenus
ggaagtaaaagtcgtaacaaggtttccgtaggtgaacctgcggaaggatcattacctagagttgtaggctttgcctgctatctcttacccatgtcttttgagtaccttcgtttcctcggcgggttcgcccgccgattggacagtttaaaccatttgcagttgcaatcagcgtctgaaaaaacttaatagttacaactttcaacaacggatctcttggttctggcatcgatgaagaacgcagcgaaatgcgataagtagtgtgaattgcagaattcagtgaatcatcgaatctttgaacgcacattgcgccccttggtattccatggggcatgcctgttcgagcgtcatttgtaccttcaagctctgcttggtgttgggtgtttgtctcgcctctgcgcgtagactcgcctcaaaacaattggcagccggcgtattgatttcggagcgcagtacatctcgcgttttgcatcacaacgacgacgtccaaaagtacattttttacactcttgacctcggatcaggtagggatacccgctgaacttaagcatatcaaaggc

SEQ ID NO: 1242 - DNA, 606 bp, Serratia marcescens
tagaggaagtaaaagtcgtaacaaggtctccgttggtgaaccagcggagggatcattaccagagtgccctaggctctccaacccattgtgaacttaccaaacgttccctcggcgggctcagcgcgcggtggcctccgggcctccgggcgtccgccggggaaaaccaaaccctgatttaatcgtatttctctgaggggcgaaagcccgaaaacaaaatgaatcaaaactttcaacaacggatctcttggctctggcatcgatgaagaacgcagcgaaatgcgataagtaatgtgaattgcagaattcagtgaatcatcgaatctttgaacgcacattgcgcccgccggcactccggcgggcatgcctgtccgagcgtcatttcaaccctcaggcccacccttccgggggagcgggcctggttctggggatcggcggccctcgcggcccccgtccctcaaattcagtggcggtcgcgccgcagcctcccctgcgtagtagcacaacctcgcaccggagagcggaacgaccacgccgtaaaacacccaattttttaaggttgacctcggatcaggtaggaatacccgctgaacttaagcatatcaataa

SEQ ID NO: 1243 - DNA, 562 bp, Escherichia hermannii
tcttggtcatttagaggaagtaaaagtcgtaacaaggtttccgtaggtgaacctgcggaaggatcattacctagagttgtaggctttgcctgctatctcttacccatgtcttttgagtaccttacgtttcctcggcgggtccgcccgccggttggacatacctaaaccctttgcagttgaaatcagcgtctgaaaaaacttaatagttacaactttcaacaacggatctcttggttctggcatcgatgaagaacgcagcgaaatgcgataagtagtgtgaattgcagaattcagtgaatcatcgaatctttgaacgcacattgcgccccttggtattccatggggcatgcctgttcgagcgtcatttgtaccttcaagctctgcttggtgttgggtgtttgtctcgtgtagactcgcctcaaaacaattggcagccggcgtattgatttcggagcgcagtacatctcgcgctttgcactcataacgacgacgtccaaaagtacattttttacgcttgacctcggatcaggtagggatacccgctgaacttaagcatatcaaa

SEQ ID NO: 1244 - DNA, 574 bp, Steroidobacter denitrificans
agaggaagtaaaagtcgtaacaaggtctccgttggtgaaccagcggagggatcattaccgagtttacaactcccaaacccctgtgaacatacctatacgttgcctcggcggatcagcccgcgccccgtaaaaagggacggcccgcccgaggacccctaaactctgtttttagtggaacttctgagtaaaacaaacaaataaatcaaaactttcaacaacggatctcttggttctggcatcgatgaagaacgcagcaaaatgcgataagtaatgtgaattgcagaattcagtgaatcatcgaatctttgaacgcacattgcgcccgccagtattctggcgggcatgcctgttcgagcgtcatttcaaccctcaagctcagcttggtgttgggactcgcggtaacccgcgttccccaaatcgattggcggtcacgtcgagcttccatagcgtagtaatcatacacctcgttactggtaatcgtcgcggccacgccgtaaaaccccaacttctgaatgttgacctcggatcaggtaggaatacccgctgaacttaagcatatcaataagcggaggaa

SEQ ID NO: 1245 - DNA, 593 bp, Acinetobacter baumannii
agaggaagtaaaagtcgtaacaaggtctccgtaggtgaacctgcggagggatcattacacaaatacaatatgaaggcttcggctggattatttatttcacccttgtcttttgcgcacttgttgtttcctgggcgggttcgcccgccaccaggaccacaccataaacctttttttatgcagttgcagtcagcgtcagtataacaaatgtaaatcatttacaactttcaacaacggatctcttggttctggcatcgatgaagaacgcagcgaaatgcgatacgtagtgtgaattgcagaattcagtgaatcatcgaatctttgaacgcacattgcgccctttggtattccaaagggcatgcctgttcgagcgtcatttgtaccctcaagctttgcttggtgttgggcgtctttttgtctttggctcgcccagagactcgccttaaaacgattggcagccggcctcctggtttcgcagcgcagcacatttttgcgcttgcaatcagcatatagaggttggcaatccatcaagactttttttttacctttgacctcggatcaggtagggatacccgctgaacttaagcatatcaata

SEQ ID NO: 1246 - DNA, 570 bp, Acinetobacter radioresistens
tcttggtcattagaggaagtaaaagtcgtaacaaggtttccgtaggtgaacctgcggaaggatcattacctagagttgtaggctttgcctgctatctcttacccatgtcttttgagtaccttcgtttcctcggcgggttcgcccgccgattggacaatttaaaccatttgcagttgcaatcagcgtctgaaaaaacttaatagttacaactttcaacaacggatctcttggttctggcatcgatgaagaacgcagcgaaatgcgataagtagtgtgaattgcagaattcagtgaatcatcgaatctttgaacgcacattgcgccccttggtattccatggggcatgcctgttcgagcgtcatttgtaccttcaagctctgcttggtgttgggtgtttgtctcgcctctgcgcgtagactcgcctcaaaacaattggcagccggcgtattgatttcggagcgcagtacatctcgcgttttgtatcacgacgacgacgtccaaaagtacattttttacactcttgacctcggatcaggtagggatacccgctgaacttaagcatatcaataa

SEQ ID NO: 1247 - DNA, 574 bp, Enhydrobacter aerosaccus
agaggaagtaaaagtcgtaacaaggtctccgttggtgaaccagcggagggatcattacagagttatccaactcccaaacccatgtgaacttatctctttgttgcctcggcgcaagctacccgggacctcgcgccccgggcggcccgccggcggacaaaccaaaactcttgttatcttagttgattatctgagtgtcttatttaataagtcaaaactttcaacaacggatctcttggttctggcatcgatgaagaacgcagcgaaatgcgataagtaatgtgaattgcagaattcagtgaatcatcgaatctttgaacgcacattgcgcccattagtattctagtgggcatgcctgttcgagcgtcatttcaacccctaagcacagcttattgttgggaacctacggcttcgtagttcctcaaagacattggcggagtggcagtggtcctctgagcgtagtaatcttttatctcgcttctgttaggtgctgcccccccggccgtaaaacccccaattttttctggttgacctcggatcaggtaggaatacccgctgaacttaagcatatcaataa

SEQ ID NO: 1248 - DNA, 609 bp, Paenibacillus taejonensis
agaggaagtaaaagtcgtaacaaggtttccgtaggtgaacctgcggaaggatcattaccgagtgagggccctctgggtccaacctcccacccgtgtttatcgtaccttgttgcttcggcgggcccgcctcacggccgccggggggcatccgcccccgggcccgcgcccgccgaagacacacaaacgaactcttgtctgaagattgcagtctgagtacttgactaaatcagttaaaactttcaacaacggatctcttggttccggcatcgatgaagaacgcagcgaaatgcgataagtaatgtgaattgcagaattcagtgaatcatcgagtctttgaacgcacattgcgccccctggtattccggggggcatgcctgtccgagcgtcattgctgccctcaagcacggcttgtgtgttgggctctcgccccccgcttccggggggcgggcccgaaaggcagcggcggcaccgcgtccggtcctcgagcgtatggggcttcgtcacccgctctgtaggcccggccggcgcccgccggcgaacaccatcaatcttaaccaggttgacctcggatcaggtagggatacccgctgaacttaagcatatcaataa

SEQ ID NO: 1249 - DNA, 590 bp, Corynebacterium sp.
agaggaagtaaaagtcgtaacaaggtctccgttggtgaaccagcggagggatcattaccgagtttcattaccgagtttacaactcccaaacccctgtgaacataccttaaacgttgcctcggcggatcagcccgcgccccgtaaaacgggacggcccgccgcaggacccttaaactctgttttctaaaagtaaattctgagtctaaaaaacaaataaatcaaaactttcaacaacggatctcttggttctggcatcgatgaagaacgcagcaaaatgcgataagtaatgtgaattgcagaattcagtgaatcatcgaatctttgaacgcacattgcgcccgccagtattctggcgggcatgcctgttcgagcgtcatttcaaccctcaagcccccgggtttggtgttggggatcgggcttaacctctaagcccggccccgaaatctagtggcggtctcgctgcagcctccattgcgtagtagctaacacctcgcaactggaacgcggcgcggccaagccgttaaacccccaacttctgaatgttgacctcggatcaggtaggaatacccgctgaacttaagcatatcaat

SEQ ID NO: 1250 - DNA, 611 bp, Cochliobolus sp.
cttggtcatttagaggaagtaaaagtcgtaacaaggtctccgtaggtgaacctgcggagggatcattacacaataaaatacgaaggccgttcgcggctggactatttattacccttgtcttttgcgcacttgttgtttcctgggcgggttcgctcgccaccaggaccacaatataaaccttttttatgcagttgcaatcagcgtcagtacaacaaaatgtaaatcatttacaactttcaacaacggatctcttggttctggcatcgatgaagaacgcagcgaaatgcgatacgtagtgtgaattgcagaattcagtgaatcatcgaatctttgaacgcacattgcgccctttggtattccaaagggcatgcctgttcgagcgtcatttgtaccctcaagctttgcttggtgttgggcgtttttgtcccccccaaaaaaggggactcgccttaaaaggattggcagccggcctactggtttcgcagcgcagcacatttttgcgcttgcaatcagcaaaagaggacggcaatccatcaagactccttctcacgtttgacctcggatcaggtagggatacccgctgaacttaagcatatcaataagcggaggaa

SEQ ID NO: 1251 - DNA, 580 bp, Phoma glomerata
tcttggtcatttagaggaagtaaaagtcgtaacaaggtttccgtaggtgaacctgcggaaggatcattacctagagttgtaggctttgcctgctatctcttacccatgtcttttgagtaccttcgtttcctcggcgggttcgcccgccgattggacaatttaaaccatttgcagttgcaatcagcgtgtgaaaaaacttaatagttacaactttcaacaacggatctcttggttctggcatcgatgaagaacgcagcgaaatgcgataagtagtgtgaattgcagaattcagtgaatcatcgaatcttttgaacgcacattgcgccccttggtattccatggggcatgcctgttcgagcgtcatttgtaccttcaagctctgcttggtgttgggtgtttgtctcgcctctgcgcgtagactcgcctcaaaacaattggcagccggcgtattgatttcggagcgcagtacatcttcgcgttttgtatcacgacgacgacgtccaaaagtacattttttacactcttgacctcggtcaggtagggatacccgctgaacttaagcatatcaataagcggagga

SEQ ID NO: 1252 - DNA, 568 bp, Phoma sp.
agaggaagtaaaagtcgtaacaaggtctccgttggtgaaccagcggagggatcattacagagttatccaactcccaaacccatgtgaacatatctctttgttgcctcggcgcaagctacccgggacctcgcgccccgggcggcccgccggcggacaaaccaaactctgttatcttcgttgattatctgagtgtcttatttaataagtcaaaactttcaacaacggatctcttggttctggcatcgatgaagaacgcagcgaaatgcgataagtaatgtgaattgcagaattcagtgaatcatcgaatctttgaacgcacattgcgcccattagtattctagtgggcatgcctgttcgagcgtcatttcaacccctaagcacagcttattgttgggcgtctacgtctgtagtgcctcaaagacattggcggagcggcagcagtcctctgagcgtagtaattctttatctcgcttctgttaggcgctgcccccccggccgtaaaacccccaattttttctggttgacctcggatcaggtaggaatacccgctgaacttaagcatatcaat

SEQ ID NO: 1253 - DNA, 590 bp, Acremonium strictum
tagaggaagtaaaagtcgtaacaaggtctccgtaggtgaacctgcggagggatcattacacaataaaatacgaaggccgtatacggctcacgatatattacccttgtcttttgcgcacttgttgtttcctgggcgggttcgctcgccaccaggaccacaatataaaccttttttgtgcagttgcaatcagcgtcagtacaacaaatgtaaatcatttacaactttcaacaacggatctcttggttctggcatcgatgaagaacgcagcgaaatgcgatacgtagtgtgaattgcagaattcagtgaatcatcgaatctttgaacgcacattgcgccctttggtattccaaagggcatgcctgttcgagcgtcatttgtaccctcaagctttgcttggtgttgggcgttttttgtcccccccaaaaaggggactcgccttaaaaggattggcagccggcctactggtttcgcagcgcagcacatttttgcgcttgcaatcagcaaaagaggacggcaatccatcaagactccttctctcgtttgacctcggatcaggtagggatacccgctgaacttaagcatatcaataa

SEQ ID NO: 1254 - DNA, 454 bp, Dothideomycete sp.
cttggtcatttagaggaagtaaaagtcgtaacaaggtctccgtaggtgaacctgcggagggatcattacacaataaaatacgaaggccgttcgcggctggactatttattacccttgtcttttgcgcacttgttgtttcctgggcgggttcgctcgccaccaggaccacaatataaaccttttttatgcagttgcaatcagcgtcagtacaacaaatgtaaatcatttacaactttcaacaacggatctcttggttctggcatcgatgaagaacgcagcgaaatgcgatacgtagtgtgaattgcagaattcagtgaatcatcgaatctttgaacgcacattgcgccctttggtattccaaagggcatgcctgttcgagcgtcatttgtaccctcaagctttgcttggtgttgggcgtttttgtcccccccaaaaaaggggactcgccttaaaa

SEQ ID NO: 1255 - DNA, 564 bp, Fusarium equiseti
ttagaggaagtaaaagtcgtaacaaggtctccgttggtgaaccagcggagggatcattaccgagtttacaactcccaaacccctgtgaacatacctatacgttgcctcggcggatcagcccgcgccctgtaaaacgggacggcccgcccgaggaccctaaactctgtttttagtggaacttctgagtaaaacaaacaaataaatcaaaactttcaacaacggatctcttggttctggcatcgatgaagaacgcagcaaaatgcgataagtaatgtgaattgcagaattcagtgaatcatcgaatctttgaacgcacattgcgcccgccagtattctggcgggcatgcctgttcgagcgtcatttcaaccctcaagctcagcttggtgttgggactcgcggtaacccgcgttccccaaatcgattggcggtcacgtcgagcttccatagcgtagtaatcatacacctcgttactggtaatcgtcgcggccacgccgtaaaaccccaacttctgaatgttgacctcggatcaggtaggaatacccgctgaacttaagcatatcata

SEQ ID NO: 1256 - DNA, 626 bp, Cochliobolus sp.
  modified_base (163)..(163): a, c, t or g
tcttggtcatttagaggaagtaaaagtcgtaacaaggtctccgttggtgaaccagcggagggatcattacagagttgcaaaactcccacaaaccatcgcgaatcttacccgtacggttgcctcggcgctggcggtccggaaaggccttcgggccctcccggancctcgggtctcccgctcgcgggaggctgcccgccggagtgccgaaactaaactcttgatattttatgtctctctgagtaaacttttaaataagtcaaaactttcaacaacggatctcttggttctggcatcgatgaagaacgcagcgaaatgcgataagtaatgtgaattgcagaattcagtgaatcatcgaatctttgaacgcacattgcgctcgccagtattctggcgagcatgcctgttcgagcgtcatttcaaccatcaagctctgcttgcgttggggatccgcggctgtccgcggtccctcaaaatcagtggcgggctcgctagtcacaccgagcgtagtaactctacatcgctatggtcgtgcggcgggttcttgccgtaaaaccccccatttctaaggttgacctcggatcaggtaggaatacccgctgaacttaagcatatcaataagcggagga

SEQ ID NO: 1257 - DNA, 636 bp, Phoma glomerata
tgaggaagtaaaagtcgtaacaaggtttccgtaggtgaacctgcggaaggatcattaaccgttacaaacagtgtgtgatgcggccgccgaggtgaatagcctctggttggtatggggttcgccccttcacgctcacgcgtctgccatccttactttacgagcaccttctgttctccctcggcaagggcctcgccctgccgttggaactacaaaactcttttttgcatctagcattacctgttccgacaaaaacaatcgtttacaactttcaacaatggatctcttggctctggcatcgatgaagaacgcagcgaaatgcgataagtagtgtgaattgcagaattcagtgaatcatctaatctttgaacgcacattgcgcccctcggtattccgtggggcatgcctgttcgagcgtcatctacaccctcaagctctgcttggtgttgggcgtctgtcccgcctccgcgcgtggactcgccccaaatacattggcagcggtctttgcctcctctcgcgcagcacattgcgcttctcgaggtgtcgcggacacgcgtccagtaagcaacatttaccgtctttgacctcggatcaggtagggatacccgctgaacttaagcatatcaataagcggaggaa

SEQ ID NO: 1258 - DNA, 613 bp, Nigrospora sphaerica
cttggtcatttagaggaagtaaaagtcgtaacaaggtctccgtaggtgaacctgcggagggatcattacacaaatacaatatgaaggcttcggctggattatttatttcacccttgtcttttgcgcacttgttgtttcctgggcgggttcgcccgccaccaggaccacaccataaacctttttttatgcagttgcagtcagcgtcagtataacaaatgtaaatcatttacaactttcaacaacggatctcttggttctggcatcgatgaagaacgcagcgaaatgcgatacgtagtgtgaattgcagaattcagtgaatcatcgaatctttgaacgcacattgcgccctttggtattccaaagggcatgcctgttcgagcgtcatttgtaccctcaagctttgcttggtgttgggcgtctttttgtctttggctcgcccttagactcgccttaaaacgattggcagccggcctcctggtttcgcagcgcagcacatttttgcgcttgcaatcagcatatagaggttggcaatccatcaagactttttttttacctttgacctcggatcaggtagggatacccgctgaacttaagcatatcaataagcggagga

SEQ ID NO: 1259 - DNA, 641 bp, Penicillium sp.
tcttggtcattagaggaagtaaaagtcgtaacaaggtctccgtaggtgaacctgcggagggatcattacacaacaaaaatatgagggtgtggtttgctggcaacagcgtccgccccaagtatttttcacccatgtcttttgcgcactttttgtttcctgggcgagttcgctcgccaccaggacccaaccataaacctttttttatgcagttgcaatcagcgtcagtataataattcaatttattaaaactttcaacaacggatctcttggttctggcatcgatgaagaacgcagcgaaatgcgatacgtagtgtgaattgcagaattcagtgaatcatcgaatctttgaacgcacattgcgccctttggtattccaaagggcatgcctgttcgagcgtcatttgtaccctcaagctttgcttggtgttgggcgtctttttgtctctccccttgttgggggagactcgccttaaaacgattggcagccgacctactggttttcggagcgcagcacaaatttgcgccttccaatccacggggcggcatccagcaagcctttgttttctataacaaatccacattttgacctcggatcaggtagggatacccgctgaacttaagcatatcaataagcggaggaa

SEQ ID NO: 1260 - DNA, 682 bp, Pappophorum krapovickasii
atactaggtgtaggggttgtcatgacctctgtgccgccgctaacgcattaagtattccgcctggggagtacggtcgcaagattaaaactcaaaggaattgacgggggcccgcacaagcagcggagcatgtggtttaattcgaagcaacgcgaagaaccttacctagacttgacatctcctgaattacccttaatcggggaagcccttcggggcaggaagacaggtggtgcatggttgtcgtcagctcgtgtcgtgagatgttgggttaagtcccgcaacgagcgcaacccttattgttagttgctaccatttagttgagcactctagcgagactgcccgggttaaccgggaggaaggtggggatgacgtcaaatcatcatgccccttatgtctagggctacacacgtgctacaatggctggtacagagagatgctaaaccgcgagtggagccaaactttaaaaccagtctcagttcggattgtaggctgaaactcgcctacatgaagctggagttgctagtaatcgcgaatcagaatgtcgcgtgaatacgttcccgggccttgtacacaccgcccgtcacaccatgagagttgcaatacccaaagttcgtgagctaacgcgtaaagcgggcagcgacctaaggtagggtcagcgattggggtgaagtcgtaacaaggtacc

SEQ ID NO: 1261 - DNA, 589 bp, Cochliobolus sp.
tagaggaagtaaaagtcgtaacaaggtctccgttggtgaaccagcggagggatcattaccgagtttacaactcccaaacccctgtgaacataccttaaacgttgcctcggcggatcagcccgcgccccgtaaaacgggacggcccgccgcaggacccttaaactctgttttctaaaagtaaattctgagtctaaaaaacaaataaatcaaaactttcaacaacggatctcttggttctggcatcgatgaagaacgcagcaaaatgcgataagtaatgtgaattgcagaattcagtgaatcatcgaatctttgaacgcacattgcgcccgccagtattctggcgggcatgcctgttcgagcgtcatttcaaccctcaagcccccgggtttggtgttggggatcgggcttaacctctaagcccggccccgaaatctagtggcggtctcgctgcagcctccattgcgtagtagctaacacctcgcaactggaacgcggcgcggccaagccgttaaacccccaacttctgaatgttgacctcggatcaggtaggaatacccgctgaacttaagcatatcaataagcggaggaa

SEQ ID NO: 1262 - DNA, 542 bp, Phoma sp.
tagaggaagtaaaagtcgtaacaaggtctccgtaggtgaacctgcggaggggacattacacaacaaaaatatgagggtgtggtttgctggcaacagcgtccgccccaagtatttttcacccatgtcttttgcgcactttttgtttcctgggcgagttcgctcgccaccaggacccaaccataaacctttttttatgcagttgcaatcagcgtcagtataataattcaatttattaaaactttcaacaacggatctcttggttctggcatcgatgaagaacgcagcgaaatgcgatacgtagtgtgaattgcagaattcagtgaatcatcgaatctttgaacgcacattgcgccctttggtattccaaagggcatgcctgttccaaagggcatgcctgttcgagcgtcatttgtaccctcaagctttgcttggtgttgggcgtctttttgtctctccccttgttgggggagactcgccttaaaacgattggcagccgacctactggttttcggagcgcagcacaaatttgcgccttccaatcc

SEQ ID NO: 1263 - DNA, 593 bp, Nigrospora sp.
agaggaagtaaaagtcgtaacaaggtctccgttggtgaaccagcggagggatcattactgagtttacgctctataaccctttgtgaacatacctataactgttgcttcggcgggtagggtctccgtgaccctcccggcctcccgcccccgggcgggtcggcgcccgccggaggataaccaaactctgatttaacgacgtttcttctgagtggtacaagcaaataatcaaaacttttaacaacggatctcttggttctggcatcgatgaagaacgcagcgaaatgcgataagtaatgtgaattgcagaattcagtgaatcatcgaatctttgaacgcacattgcgcccgccagcattctggcgggcatgcctgttcgagcgtcatttcaaccctcaagctctgcttggtgttggggccctacagctgatgtaggccctcaaaggtagtggcggaccctcccggagcctcctttgcgtagtaactttacgtctcgcactgggatccggagggactcttgccgtaaaacccccaattttccaaaggttgacctcggatcaggtaggaatacccgctgaacttaagcatatcaataa

SEQ ID NO: 1264 - DNA, 494 bp, Cochliobolus hawaiiensis
agaggaagtaaaagtcgtaacaaggtctccgtaggtgaacctgcggagggatcattacacaacaaaaatatgagggtgtggtttgctggcaacagcgtccgccccaagtatttttcacccatgtcttttgcgcactttttgtttcctgggcgagttcgctcgccaccaggacccaaccataaacctttttttatgcagttgcaatcagcgtcagtataataattcaatttattaaaactttcaacaacggatctcttggttctggcatcgatgaagaacgcagcgaaatgcgatacgtagtgtgaattgcagaattcagtgaatcatcgaatctttgaacgcacattgcgccctttggtattccaaagggcatgcctgttcgagcgtcatttgtaccctcaagctttgcttggtgttgggcgtctttttgtctctccccttgttgggggagactcgccttaaaacgattggcagccgacctactggttttcgga

SEQ ID NO: 1265 - DNA, 630 bp, Cochliobolus sp.
tttggtcatttagaggaagtaaaagtcgtaacaaggtctccgtaggtgaacctgcggagggatcattacacaacaaaaatatgagggtgtggtttgctggcaacagcgtccgccccaagtatttttcacccatgtcttttgcgcactttttgtttcctgggcgagttcgctcgccaccaggacccaaccataaacctttttttatgcagttgcaatcagcgtcagtataataattcaatttattaaaactttcaacaacggatctcttggttctggcatcgatgaagaacgcagcgaaatgcgatacgtagtgtgaattgcagaattcagtgaatcatcgaatctttgaacgcacattgcgccctttggtattccaaagggcatgcctgttcgagcgtcatttgtaccctcaagctttgcttggtgttgggcgtctttttgtctctccccttgttgggggagactcgccttaaaacgattggcagccgacctactggttttcggagcgcagcacaaatttgcgccttccaatccacggggcggcatccagcaagcctttgttttctataacaaatccacattttgacctcggatcaggtagggatacccgctgaacttaagcatatcaat

SEQ ID NO: 1266 - DNA, 461 bp, Fusarium equiseti
ccgccccccctccccggggggtggctagtgcccgccagaggaccatcaaactccagtcagtgaacgtcgcagtctgaaaaaacattcaataaactaaaactttcaacaacggatctcttggttctggcatcgatgaagaacgcagcgaaatgcgataagtaatgtgaattgcagaattcagtgaatcatcgaatctttgaacgcacattgcgccccttggtattccgaggggcatgcctgttcgagcgtcattacaaccctcaagctctgcttggtattgggcaccgcccttcttcgggcgcgcctcaaagacctcggcggtggctgtcttgcctcaagcgtagtagaatacacctcgcttcggagcgcagggcgtcgcccgccggacgaaccttctgaacttttctcaaggttgacctcggatcaggtagggatacccgctgaacttaagcatatcaata

SEQ ID NO: 1267 - DNA, 570 bp, Neurospora crassa
ttagaggaagtaaaagtcgtaacaaggtctccgtaggtgaacctgcggagggatcattacaagtgaccccggtctaaccaccgggatgttcataaccctttgttgtccgactctgttgcctccggggcgaccctgccttcgggcgggggctccgggtggacacttcaaactcttgcgtaactttgcagtctgagtaaacttaattaataaattaaaacttttaacaacggatctcttggttctggcatcgatgaagaacgcagcgaaatgcgataagtaatgtgaattgcagaattcagtgaatcatcgaatctttgaacgcacattgcgccccctggtattccggggggcatgcctgttcgagcgtcatttcaccactcaagcctcgcttggtattgggcaacgcggtccgccgcgtgcctcaaatcgaccggctgggtcttctgtcccctaagcgttgtggaaactattcgctaaagggtgttcgggaggctacgccgtaaaacaaccccatttctaaggttgacctcggatcaggtagggatacccgctgaacttaagcatatcata

SEQ ID NO: 1268 - DNA, 687 bp, Leptothrium rigidum
cgacttggaggttgtgcccttgaggcgtggcttccggagctaacgcgctaagtcgaccgcctggggcgtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatgactgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcatatataaagagaagcgacctcgcgagagcaagcggacctcataaagtatgtcgtagtccggattggagtctgcaactcgactccatgaagtcggaatcgctagtaatcgtggatcagaatgccacggtgaatacgttcccgggcctcgtacacaccgcccgtcacaccatgggagtgggttgcaaaagaagtaggtagcttaaccttcgggagggcgcttaccactttgtgattcatgactgggatgaagtcgtaacaaggtaac

SEQ ID NO: 1269 - DNA, 568 bp, Cochliobolus sp.
gaggaagtaaaaagtcgtaacaaggtctccgtaggtgaacctgcggagggatcattacaagtgaccccggtctaaccaccgggatgttcataaccctttgttgtccgactctgttgcctccggggcgaccctgccttcgggcgggggctccgggtggacacttcaaactcttgcgtaactttgcagtctgagtaaacttaattaataaattaaaacttttaacaacggatctcttggttctggcatcgatgaagaacgcagcgaaatgcgataagtaatgtgaattgcagaattcagtgaatcatcgaatctttgaacgcacattgcgccccctggtattccggggggcatgcctgttcgagcgtcatttcaccactcaagcctcgcttggtattgggcaacgcggtccgccgcgtgcctcaaatcgaccggctgggtcttctgtcccctaagcgttgtggaaactattcgctaaagggtgctcgggaggctacgccgtaaaacaaacccatttctaaggttgacctcggatcaggtagggatacccgctgaacttaagcatatcaat

SEQ ID NO: 1270 - DNA, 573 bp, Exserohilum rostratum
agaggaagtaaaagtcgtaacaaggtttccgtaggtgaacctgcggaaggaacattacctagagttgtaggctttgcctgctatctcttacccatgtcttttgagtaccttacgtttcctcggcgggtccgcccgccgattggacaaacttaaaccatttgcagttgcaatcagcgtctgaaaaaaacttaatagttacaactttcaacaacggatctcttggttctggcatcgatgaagaacgcagcgaaatgcgataagtagtgtgaattgcagaattcagtgaatcatcgaatctttgaacgcacattgcgccccttggtattccatggggcatgcctgttcgagcgtcatttgtaccttcaagctctgcttggtgttgggtgtttgtctcgcctctgcgtgtagactcgcctcaaaacaattggcagccggcgtattgatttcggagcgcagtacatctcgcgctttgcactcataacgacgagcgtccaaaagtacattttttacactcttgacctcggatcaggtagggatacccgctgaacttaagcatatcaataagcggaggaa

SEQ ID NO: 1271 - DNA, 687 bp, Eragrostis ciliaris; identical to SEQ ID NO: 1268

SEQ ID NO: 1272 - DNA, 682 bp, Eragrostis ciliaris
caactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctggagagatctgggagtgctcgaaagagaaccgatacacaggtgctgcatggctgtcgtcagctcgtgtcgtgagatgttgggttaagtcccgcaacgagcgcaacccttgtccttagttgctacgcaagagcactctagggagactgccggtgacaaaccggaggaaggtggggatgacgtcaagtcctcatggcccttatgggtagggcttcacacgtcatacaatggtcggaacagagggtcgccaacccgcgagggggagctaatcccagaaaaccgatcgtagtccggattgcactctgcaactcgagtgcatgaagctggaatcgctagtaatcgcggatctgcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtatc

SEQ ID NO: 1273 - DNA, 560 bp, Colletotrichum gloeosporioides
agaggaagtaaaagtcgtaacaaggtttccgtaggtgaacctgcggaaggatcattacctagagttgtaggctttgcctgctatctcttacccatgtcttttgagtaccttacgtttcctcggcgggtccgcccgccgattggacactttaaaccatttgcagttgcaatcagcgtctgaaaaaacttaatagttacaactttcaacaacggatctcttggttctggcatcgatgaagaacgcagcgaaatgcgataagtagtgtgaattgcagaattcagtgaatcatcgaatctttgaacgcacattgcgccccttggtattccatggggcatgcctgttcgagcgtcatttgtaccttcaagctttgcttggtgttgggtgtttgtctcgcctctgcgtgtagactcgcctcaaaacaattggcagccggcgtattgatttcggagcgcagtacatctcgcgctttgcactcataacgacgacgtccaaaagtacatttttacactcttgacctcggatcaggtagggatacccgctgaacttaagcatatcaataa

SEQ ID NO: 1274 - DNA, 575 bp, Pleosporaceae sp.
agaggaagtaaaagtcgtaacaaggtctccgtaggtgaacctgcggagggatcattacacaaaaaaatatgaaggctgactgcagctgacctacatggccagtttgctcgaggctgaattattttttcacccatgtcttttgcgcacttgttgtttcctgggcgggttcgcaaaccaccaggaccacaccataaacctttttatctgtagttgcaatcagcgtcagtaacaagtaaataatcatttacaactttcaacaacggatctcttggttctggcatcgatgaagaacgcagcgaaatgcgatacgtagtgtgaattgcagaattcagtgaatcatcgaatctttgaacgcacattgcgccctttggtattccaaagggcatgcctgttcgagcgtcatttgtaccctcaagctttgcttggtgttgggcgtttttgtctttggctacagcccgaagactcgccttaaaacgattggcagccggcctactggtttcgcagcgcagcacatttttgcgcttgcaatcagcaaaagaggttggcgatccatcaagtcttactttctcactttt

SEQ ID NO: 1275 - DNA, 602 bp, Exserohilum rostratum
tagaggaagtaaaagtcgtaacaaggtctccgttggtgaaccagcggagggatcattaccgagtgtaaaaactcccaaaccattgtgaacctaccactgttgcttcggcggcctcgccccgggcgcgttcgcgcggcccggacccaggcgtccgccggaggctccaaactcttgtcttttagtgtatttctgagtggcataagcaaataaatcaaaactttcagcaacggatctcttggttctggcatcgatgaagaacgcagcaaaatgcgataagtaatgtgaattgcagaattcagtgaatcatcgaatctttgaacgcacattgcgcccgccagtattctggcgggcatgcctgtctgagcgtcatttcaaccctcaggacccgttcgcgggacctggcgttggggatcagcctgcccctggcggcggctggccctgaaatccagtggcggttccctcgcgaactcctccgtgcagtaattaaacctctcgcggcaggatagcggttgaaccacgccgttaaaccccccacttctcaaggttgacctcagatcaggtaggaatacccgctgaacttaagcatatcaataagcggagga

SEQ ID NO: 1276 - DNA, 587 bp, Botryosphaeria sp.
agaggaagtaaaagtcgtaacaaggtctccgtaggtgaacctgcggagggatcattacacaaatatgaaggcgggctggaatctctcggggttacagccttgctgaattattcacccttgtcttttgcgtacttcttgtttccttggtgggttcgcccaccactaggacaaacataaaccttttgtaattgcaatcagcgtcagtaacaaattaataattacaactttcaacaacggatctcttggttctggcatcgatgaagaacgcagcgaaatgcgataagtagtgtgaattgcagaattcagtgaatcatcgaatctttgaacgcacattgcgccctttggtattccaaagggcatgcctgttcgagcgtcatttgtaccctcaagctttgcttggtgttgggcgtcttgtctctagctttgctggagactcgccttaaagtaattggcagccggcctactggtttcggagcgcagcacaagtcgcactctctatcagcaaaggtctagcatccattaagcctttttttcaacttttgacctcggatcaggtagggatacccgctgaacttaagcatatcaat

SEQ ID NO: 1277 - DNA, 416 bp, Cladosporium sp.
ttgcctcggcggatcagcccgcgccccgtaaaacgggacggcccgcccgaggacccctaaactctgtttttagtggaacttctgagtaaaacaaacaaataaatcaaaactttcaacaacggatctcttggttctggcatcgatgaagaacgcagcaaaatgcgataagtaatgtgaattgcagaattcagtgaatcatcgaatctttgaacgcacattgcgcccgccagtattctggcgggcatgcctgttcgagcgtcatttcaaccctcaagctcagcttggtgttgggactcgcggtaacccgcgttccccaaatcgattggcggtcacgtcgagcttccatagcgtagtaatcatacacctcgttactggtaatcgtcgcggccacgccgtaaaaccccaacttctgaatg

SEQ ID NO: 1278 - DNA, 601 bp, Cladosporium oxysporum
tagaggaagtaaaagtcgtaacaaggtctccgttggtgaaccagcggagggatcattacagagttgcaaaactcccacaaaccatcgcgaatcttacccgtacggttgcctcggcgctggcggtccggaaggccctcgggcccccggaccctcgggtctcccgctcgcgggaggctgcccgccggagtgccgaaaccaaactcttgatattttatgtctctctgagtaaacttttaaataagtcaaaactttcaacaacggatctcttggttctggcatcgatgaagaacgcagcgaaatgcgataagtaatgtgaattgcagaattcagtgaatcatcgaatctttgaacgcacattgcgctcgccagtattctggcgagcatgcctgttcgagcgtcatttcaaccatcaagctctgcttgcgttggggatccgcggctgcccgcggtccctcaaaaacagtggcgggctcgctagtcacaccgagcgtagtaactctacatcgctatggtcgtgcggcgggttcttgccgtaaaacccccaatttctaaggttgacctcggatcaggtaggaatacccgctgaacttaagcatatcaa

SEQ ID NO: 1279 - DNA, 567 bp, Phoma moricola
aagtaaaagtcgtaacaaggtctccgtaggtgaacctgcggagggatcattacacaaataacatatgaaggctgtacgcggctgtgccctttgggtgcagcgtctgctgcggctggattatttattttcacccttgtcttttgcgcacttgttgtttcctgggcgggttcgcccgccaccaggaccacatgataaaccttttttatgcagttgcaatcagcgtcagtacaacaaaatgtaaatcatttacaactttcaacaacggatctcttggttctggcatcgatgaagaacgcagcgaaatgcgatacgtagtgtgaattgcagaattcagtgaatcatcgaatctttgaacgcacattgcgccctttggtattccaaagggcatgcctgttcgagcgtcatttgtaccctcaagctttgcttggtgttgggcgtcttgtctttgctccgccaaagactcgccttaaaacgattggcagccggcctactggtttcgcagcgcagcacatttttgcgcttgcaatcagcaaaagaggacggcactccatcaagactccttctcac

SEQ ID NO: 1280 - DNA, 471 bp, Phoma glomerata
tttggtcatttagaggaagtaaaagtcgtaacaaggtttccgtaggtgaacctgcggaaggatcattacctagagttgtaggctttgcctgctatctcttacccatgtcttttgagtaccttacgtttcctcggtgggttcgcccaccgattggacaaatttaaaccctttgcagttgaaatcagcgtctgaaaaaacttaatagttacaactttcaacaacggatctcttggttctggcatcgatgaagaacgcagcgaaatgcgataagtagtgtgaattgcagaattcagtgaatcatcgaatctttgaacgcacattgcgccccttggtattccatggggcatgcctgttcgagcgtcatttgtaccttcaagctctgcttggtgttgggtgtttgtctcctgtagactcgccttaaaacaattggcagccggcgtattgatttcggagcggcatacatctcgcggc

SEQ ID NO: 1281 - DNA, 571 bp, Curvularia oryzae
gaggaagtaaaagtcgtaacaaggtctccgtaggtgaacctgcggagggatcattaccagtgacccccggcttcggccggggatgatcataaccctttgctgtccgactctgttgcctccggggcgaccctgcctccgggcgggggccccgggtggacacattcaaactcttgcgtaactttgcagtctgagtaaatttaattaataaattaaaactttcaacaacggatctcttggttctggcatcgatgaagaacgcagcgaaatgcgataagtaatgtgaattgcagaattcagtgaatcatcgaatctttgaacgcacattgcgccccctggtattccggggggcatgcctgttcgagcgtcatttcaccactcaagcctcgcttggtattgggcgacgcggtccgccgcgcgcctcaaatcgaccggctgggtcttctgtcccctcagcgttgtggaaactattcgctaaagggtgccacgggaggtcacgccgtaaaacaagcccatttctaaggttgacctcggatcaggtagggatacccgctgaacttaagcatatcaataa

SEQ ID NO: 1282 - DNA, 574 bp, Acremonium alternatum
agaggaagtaaaagtcgtaacaaggtctccgttggtgaaccagcggagggatcattacagagttatccaactcccaaacccatgtgaacttatctctttgttgcctcggcgcaagctacccgggacccagcgccccgggcggcccgccggcggacaaaccaaactcttgttatcttagttgattatctgagcgtcttatttaataagtcaaaactttcaacaacggatctcttggttctggcatcgatgaagaacgcagcgaaatgcgataagtaatgtgaattgcagaattcagtgaatcatcgaatctttgaacgcacattgcgcccattagtattctagtgggcatgcctgttcgagcgtcatttcaacccctaagcacagcttactgttgggactctacggcctccgtagttccctaatgcgattggcggagtggcagtagtcctctgagcgtagtaattctttatctcgcttttgttaggtgctgcccccccggccgttaaacccccaattttttctggttgacctcggatcaggtaggaatacccgctgaacttaagcatatcaataa

SEQ ID NO: 1283 - DNA, 533 bp, Alternaria sp.
tttggtcatttagaggaagtaaaagtcgtaacaaggtctccgttggtgaaccagcggagggatcattaccgagtttacaactcccaaacccctgtgaacatacctatacgttgcctcggcggatcagcccgcgccctgtaaaaagggacggcccgcccgaggaccctaaactctgtttttagtggaacttctgagtaaaacaaacaaataaatcaaaactttcaacaacggatctcttggttctggcatcgatgaagaacgcagcaaaatgcgataagtaatgtgaattgcagaattcagtgaatcatcgaatctttgaacgcacattgcgcccgccagtattctggcgggcatgcctgttcgagcgtcatttcaaccctcaagctcagcttggtgttgggactcgcggtaacccgcgttccccaaatcgattggcggtcacgtcgagcttccatagcgtagtaatcatacacctcgttactggtaatcgtcgcggccacgccgtaaaaccccaacttctgaatgttgacctc

SEQ ID NO: 1284 - DNA, 537 bp, Fusarium equiseti
cattacacaataaaatacgaaggccgttcgcggctggactatttattacccttgtcttttgcgcacttgttgtttcctgggcgggttcgctcgccaccaggaccacaatataaaccttttttatgcagttgcaatcagcgtcagtataacaaatgtaaatcatttacaactttcaacaacggatctcttggttctggcatcgatgaagaacgcagcgaaatgcgatacgtagtgtgaattgcagaattcagtgaatcatcgaatctttgaacgcacattgcgccctttggtattccaaagggcatgcctgttcgagcgtcatttgtaccctcaagctttgcttggtgttgggcgttttttgtcccccccaaaaaggggactcgccttaaaaggattggcagccggcctactggtttcgcagcgcagcacatttttgcgcttgcaatcagcaaaagaggacggcaatccatcaagactccttctcacgtttgacctcggatcaggtagggatacccgctgaacttaagcatatcaata

SEQ ID NO: 1285 - DNA, 637 bp, Sordaria tomento alba
tttggtcattagaggaagtaaaagtcgtaacaaggtctccgtaggtgaacctgcggagggatcattacacaataaaatatgaaggctgtacgcggctgtgctctcgggccagttttgcggaagctgaattatttattacccttgtcttttgcgcacttgttgtttcctgggcgggttcgcccgccaccaggaccacatcataaaccttttttatgcagttgcaatcagcgtcagtataacaaatgtaaatcatttacaactttcaacaacggatctcttggttctggcatcgatgaagaacgcagcgaaatgcgatacgtagtgtgaattgcagaattcagtgaatcatcgaatctttgaacgcacattgcgccctttggtattccaaagggcatgcctgttcgagcgtcatttgtaccctcaagctttgcttggtgttgggcgttttttgtctttggttgccaaagactcgccttaaaaggattggcagccggcctactggtttcgcagcgcagcacatttttgcgcttgcaatcagcaaaagaggacggcaatccatcaagacttccttctcacgtttgacctcggatcaggtagggatacccgctgaacttaagcatatcaataagcggaggaa

SEQ ID NO: 1286 - DNA, 594 bp, Curvularia sichuanensis
  modified_base (141)..(141): a, c, t or g
tcttggtcatttagaggaagtaaaagtcgtaacaaggtctccgtaggtgaacctgcggagggatcattacacaataaaatacgaaggccgttcgcggctggactatttattacccttgtcttttgcgcacttgttgtttcntgggcgggttcgctcgccaccaggaccacaatattaaaccttttttatgcagttgcaatcagcgtcagtataacaaatgtaaatcatttacaactttcaacaacggatctcttggttctggcatcgatgaagaacgcagcgaaatgcgatacgtagtgtgaattgcagaattcagtgaatcatcgaatctttagaacgcacattgcgccctttggtattccaaagggcatgcctgttcgagcgtcatttgtaccctcaagctttgcttggtgttgggcgttttttgtcccccccaaaaaggggaactcgccttaaaaggattggcagccggcctactggtttcgcagcgcagcacatttttgcgcttgcaatcagcaaaagaggacggcaatccatcaagactccttctcacgtttgacctcggatcaggtagggatacccgctgaacttaag

SEQ ID NO: 1287 - DNA, 578 bp, Phoma sp.
tcttggtcatttagaggaagtaaaagtcgtaacaaggtctccgttggtgaaccagcggagggatcattaccgagtttacaactcccaaacccctgtgaacatacctatacgttgcctcggcggatcagcccgcgccctgtaaaaagggacggcccgcccgaggaccctaaactctgtttttagtggaacttatgagtaaaacaaacaaataaatcaaaactttcaacaacggatctcttggttctggcatcgatgaagaacgcagcaaaatgcgataagtaatgtgaattgcagaattcagtgaatcatcgaatctttgaacgcacattgcgcccgccagtattctggcgggcatgcctgttcgagcgtcatttcaaccctcaagctcagcttggtgttgggactcgcggtaacccgcgttccccaaatcgattggcggtcacgtcgagcttccatagcgtagtaatcatacacctcgttactggtaatcgtcgcggccacgccgtaaaaccccaacttctgaatgttgacctcggatcaggtaggaatacccgctgaacttaagcatatcaataagc

SEQ ID NO: 1288 - DNA, 572 bp, Cladosporium sp.
tttggtcatttagaggaagtaaaagtcgtaacaaggtctccgttggtgaaccagcggagggatcattacagagttgcaaaactccccaaaccatcgtgaacctttaccgctaaacagttgcttcggcgggtggcccgcgggtgtgcgcgcgcgcaagccgcgcccccgggggccgccgagcccgccggaggaatccaaaaaaccatcgctttcagtaccggcctctctgagttactgtacttttaattaagtcaaaactttcaacaacggatctcttggttctggcatcgatgaagaacgcagcgaaatgcgataagtaatgtgaattgcagaattcagtgaatcatcgaatctttgaacgcacattgcgcccgccagtattctggcgggcatgcctgttcgagcgtcatttccaccatcaggcccccgggcctgtgttggggacctgcggctgcccgcaggccccgaaattcagtggcggtcgcgccgtagcaaccgagcgtagtaactaaaacgtctcggctctggctcgctgggcgcgctccggccgtaaaatacccccccttttcgcg

SEQ ID NO: 1289 - DNA, 603 bp, Nigrospora oryzae
cttggtcatttagaggaagtaaaagtcgtaacaaggtctccgtaggtgaacctgcggagggatcattacacaataaaatacgaaggccgttcgcggctggactatttattacccttgtcttttgcgcacttgttgtttcctgggcgggttcgctcgccaccaggaccacaatataaaccttttttatgcagttgcaatcagcgtcagtataacaaatgtaaatcatttacaactttcaacaacggatctcttggttctggcatcgatgaagaacgcagctgaaatgcgatacgtagtgtgaattgcagaattcagtgaatcatcgaatctttgaacgcacattgcgccctttggtattccaaagggcatgcctgtcgagcgtcattccgtaccctcaagctttgcttggtgttgggcgttttttgtcccccccaaatccctcaagctttgcttggtgttgggcgttttttgtcccccccaaatcacatttttgcgcttgcaatcagcaaaagaggacggcaatccatcaagactccttctcacgtttgacctcggatcaggtagggatacccgctgaacttaagcatatcaataagcggagga

SEQ ID NO: 1290 - DNA, 539 bp, Fusarium sp.
ggacattacagagttgcaaaactccctaaaccattgtgaagacccttaaccgttgcttcggcgggcggcgccatgccgcccctcggcccttcccgggcgcccgccggaggatacccaactcttgatattttatggccactctgagtcttctgtactgaataagtcaaaactttcaacaacggatctcttggttctggcatcgatgaagaacgcagcgaaatgcgataagtaatgtgaattgcagaattcagtgaatcatcgaatctttgaacgcacattgcgcccgccagtattctggcgggcatgcctgttcgagcgtcatttcaaccatcaagcccccggcttgtgttggggacctgcggctgcccgcaggccctgaaaaacagtggcgggctcgctgtcacaccgagcgtagtagcatcattctcgctcagggcgtgctgcgggttccggccgttaaacgaccttcataacccaaggttgacctcggatcaggtaggaagacccgctgaacttaagcatatcaataagcggaggaa

SEQ ID NO: 1291 - DNA, 592 bp, Cochliobolus hawaiiensis
tttggtcattagaggaagtaaaagtcgtaacaaggtctccgttggtgaaccagcggagggatcattaccgagtttacaactcccaaaccccaatgtgaacgttaccaatccgttgcctcggcgggattctcttgccccgggcgcgtcgcagccccggatcccatggcgcccgccggaggaccaactccaaactcttttttctctccgtcgcggctcccgtcgcggctctgttttatttttgctctgagcctttctcggcgaccctctagcgggcgtctcgaaaatgaatcaaaactttcaacaacggatctcttggttctggcatcgatgaagaacgcagcgaaatgcgataagtaatgtgaattgcagaattcagtgaatcatcgatctttgaacgcacattgcgcccgccagtattctggcgggcatgcctgtccgagcgtcatttcaaccctcgaacccctccggggggtcggcgttggggacggcccctcaccgggccgcccccgaatacagtggcggtctcgccgcagcctctcctgcgcatatttgcaactcgcacgggacgcggcgcggcccaccgtaaacaccc

SEQ ID NO: 1292 - DNA, 609 bp, Cochliobolus lunatus
  modified_base (509)..(509): a, c, t or g
cttggtcattagaggaagtaaaagtcgtaacaaggtctccgtaggtgaacctgcggagggatcattacacaatacaatatgaaggctgtgtgacgttcatcttcgacagctggattattttattacccttgtcttttgcgcacttgttgtttcctgggcgggttcgcccgccaccaggaccaccatataaaccttttttatgcagttgcaatcagcgtcagtaacaaaatgtaaatcatttacaactttcaacaacggatctcttggttctggcatcgatgaagaacgcagcgaaatgcgatacgtagtgtgaattgcagaattcagtgaatcatcgactctttgaacgcacattgcgccctttggtattccaaagggcatgcctgttcgagcgtcatttgtaccctcaagctttgcttggtgttgggcgtttttttgtctttgggtccgccaaagactcgccttaaagtgattggcagccggcctactggtttcgcagcgcagcacanttttgcgcttgcaagaggacggcaatccatcaagactcctttctcacgtttgacctcggtcaggtagggatacccgctgaacttaagcatatcaataagc

SEQ ID NO: 1293 - DNA, 610 bp, Cochliobolus sp.
tcttggtcatttagaggaagtaaaagtcgtaacaaggtctccgtaggtgaacctgcggagggatcattacacaataaaatacgaaggccgttcgcggctggactatttattacccttgtcttttgcgcacttgttgtttcctgggcgggttcgctcgccaccaggaccacaatacaaaccttttttatgcagttgcaatcagcgtcagtacaacaaatgtaaatcatttacaactttcaacaacggatctcttggttctggcatcgatgaagaacgcagcgaaatgcgatacgtagtgtgaattgcagaattcagtgaatcatcgaatctttgaacgcacattgcgccctttggtattccaaagggcatgcctgttcgagcgtcatttgtaccctcaagctttgcttggtgttgggcgtttttgtcccccccaaaaaggggactcgccttaaaaggattggcagccggcctactggtttcgcagcgcagcacatttttgcgcttgcaatcagcaaaagaggacggcaatccatcaagactccttctcacgtttgacctcggatcaggtagggatacccgctgaacttaagcatatcaataagcggaggaa

SEQ ID NO: 1294 - DNA, 579 bp, Fusarium sp.
tgaggaagtaaaagtcgtaacaaggtctccgttggtgaaccagcggagggatcattacagagttatccaactcccaaacccatgtgaacatatctctttgttgcctcggcgcaagctacccgggacctcgcgccccgggcggcccgccggcggacaaaccaaactctgttatcttcgttgattatctgagtgtcttatttaataagtcaaaactttcaacaacggatctcttggttctggcatcgatgaagaacgcagcgaaatgcgataagtaatgtgaattgcagaattcagtgaatcatcgaatctttgaacgcacattgcgcccattagtattctagtgggcatgcctgttcgagcgtcatttcaacccctaagcacagcttattgttgggcgtctacgtctgtagtgcctcaaagacattggcggagcggcagcagtcctctgagcgtagtaattctttatgtcgcttctgttaggcgctgcccccctggccgtaaaacccccaattttttctggttgacctcggatcaggtaggaatacccgctgaacttaagcatatcaataagcggaggaa

SEQ ID NO: 1295 - DNA, 525 bp, Cladorrhinum bulbillosum
acacaacaaaaatatgagggtgtggtttgctggcaacagcgtccgccccaagtatttttcacccatgtcttttgcgcactttttgtttcctgggcgagttcgctcgccaccaggacccaaccataaacctttttttatgcagttgcaatcagcgtcagtataataattcaatttattaaaactttcaacaacggatctcttggttctggcatcgatgaagaacgcagcgaaatgcgatacgtagtgtgaattgcagaattcagtgaatcatcgaatctttgaacgcacattgcgccctttggtattccaaagggcatgcctgttcgagcgtcatttgtaccctcaagctttgcttggtgttgggcgtctttttgtctctccccttgttgggggagactcgccttaaaacgattggcagccgacctactggttttcggagcgcagcacaaatttgcgccttccaatccacggggcggcatccagcaagcctttgttttctataacaaatccacattttgacctcgg

SEQ ID NO: 1296 - DNA, 491 bp, Curvularia sp.
ctacggtttacctaacactgttgcttcggcggggagccccccaggggcgagccgccggggaccactgaacttcatgcctgagagtgatgcagtctgagcctgaatacaaatcagtcaaaactttcaacaatggatctcttggttccggcatcgatgaagaacgcagcgaactgcgataagtaatgtgaattgcagaattcagtgaatcatcgagtctttgaacgcacattgcgccccctggcattccggggggcatgcctgtccgagcgtcattgctgccctcaagcccggcttgtgtgttgggtcgtcgtcccccccgggggacgggcccgaaaggcagcggcggcaccgtgtccggtcctcgagcgtatggggctttgtcacccgctcgattagggccggccgggcgccagccggcgtctccaaccttatttttctcaggttgacctcggatcaggtagggatacccgctgaacttaagcatatcaata

SEQ ID NO: 1297 - DNA, 601 bp, Corynascus kuwaitiensis
tttggtcattagaggaagtaaaagtcgtaacaaggtctccgttggtgaaccagcggagggatcattacagagttatccaactcccaaacccatgtgaacatatctctttgttgcctcggcgcaagctacccgggacctcgcgccccgggcggcccgccggcggctcgcgccccgggcggcccgccggcggtgttatctcgttgattatctgagtgtcttatttaataagtcaaaactttcaacaacggatctcttggttctggcatcgatgaagaacgcagcgaaatgcgataagtaatgtgaattgcagaattcagtgaatcatcgaatctttgaacgcacattgcgcccattagtattctagtgggcatgcctgttcgagcgtcatttcaacccctaagcacagcttattgttgggcgtctacgtctgtagtgcctcaaagacattggcggagcggcagcagtcctctgagcgtagtaattctttatctcgcttctgttaggcgctgcccccccggccgtaaaacccccaattttttctggttgacctcggatcaggtaggaatacccgctgaacttaagcatatcaataagcggagga

SEQ ID NO: 1298 - DNA, 590 bp, Trichoderma sp.
agaggaagtaaaagtcgtaacaaggtctccgtaggtgaacctgcggagggatcattacacaataaaatacgaaggccgttcgcggctggactatttaatacccttgtcttttgcgcacttgttgtttccagggcgggttcgctcgccaccaggaccacaatataaaccttttttatgcagttgcaatcagcgtcagtataacaaatgtaaatcatttacaactttcaacaacggatctcttggttctggcatcgatgaagaacgcagcgaaatgcgatacgtagtgtgaattgcagaattcagtgaatcatcgaatctttgaacgcacattgcgccctttggtattccaaagggcatgcctgttcgagcgtcatttgtaccctcaagctttgcttggtgttgggcgttttttgtcccccccaaaaaggggactcgccttaaaaggattggcagccggcctactggtttcgcagcgcagcacatttttgcgcttgcaatcagcaaaagaggacggcaatccatcaagactccttctcacgtttgacctcggatcaggtagggatacccgctgaacttaagcatatcaataa

SEQ ID NO: 1299 - DNA, 687 bp, Cenchrus echinatus
cgacttggaggttgtgccctcgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggcgccttcgggaactctgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcatcaagtgcgtcgtagtccggattggagtctgcaactcgactccatgaagtcggaatcgctagtaatcgtagatcagaatgctacggtgaatacgttcccgggccttgtacacaccgcccgtcacaccatggagtgggttgcaaaagaagtaggtagcttaaccttcgggagggcgcttaccactttgtgattcatgactgggggtgaagtcgtaacaagatagc

SEQ ID NO: 1300 - DNA, 583 bp, Cochliobolus hawaiiensis
tttggtcattagaggaagtaaaagtcgtaacaaggtctccgtaggtgaacctgcggagggatcattacaagtgaccccggtctaaccaccgggacgttctaaaccctttgttgtccgactctgttgcctccggggcgaccctgccttcgggcgggggctccgggtggacacttcaaactcttgcgtaactttgcagtctgagtaaacttaattaataaattaaaacttttaacaacggatctcttggttctggcatcgatgaagaacgcagcgaaatgcgataagtaatgtgaattgcagaattcagtgaatcatcgaatctttgaacgcacattgcgccccctggtattccggggggcatgcctgttcgagcgtcatttcaccactcaagcctcgcttggtattgggcaacgcggtccgccgcgtgcctcaaatcgaccggctgggtcttctgtcccctaagcgttgtggaaactattcgctaaagggtgctcgggaggctacgccgtaaaacaaacccatttctaaggttgacctcggatcaggtagggatacccgctgaacttaagcatatcaataagcg

SEQ ID NO: 1301 - DNA, 433 bp, Nigrospora sphaerica
gcctgctactcttacccatgtcttttgagtaccttacgtttcctcggcgggtccgcccgccggttggacatacctaaaccctttgcagttgaaatcagcgtctgaaaaaacttaatagttacaactttcaacaacggatctcttggttctggcatcgatgaagaacgcagcgaaatgcgataagtagtgtgaattgcagaattcagtgaatcatcgaatctttgaacgcacattgcgccccttggtattccatggggcatgcctgttcgagcgtcatttgtaccttcaagctctgcttggtgttgggtgtttgtctcgtgtagactcgcctcaaaacaattggcagccggcgtattgatttcggagcgcagtacatctcgcgctttgcactcataacgacgacgtccaaaagtacattttttacgcttgacct

SEQ ID NO: 1302 - DNA, 561 bp, E. rostratum
agaggaagtaaaagtcgtaacaaggtttccgtaggtgaacctgcggaaggatcattacctagagttgtaggctttgcctgctatctcttacccatgtcttttgagtaccttcgtttcctcggcgggtccgcccgccgattggacacatttaaaccctttgtagttgcaatcagcgtctgaaaaactttaatagttacaactttcaacaacggatctcttggttctggcatcgatgaagaacgcagcgaaatgcgataagtagtgtgaattgcagaattcagtgaatcatcgaatctttgaacgcacattgcgccccttggtattccatggggcatgcctgttcgagcgtcatttgtaccttcaagctttgcttggtgttgggtgtttgtctcgcctctgcgcgcagactcgcctcaaaacaattggcagccggcgtattgatttcggagcgcagtacatctcgcgctttgcactcataacgacgacgtccaaaaagtacattttttacactcttgacctcggatcaggtagggatacccgctgaacttaagcatatcaata

SEQ ID NO: 1303 - DNA, 624 bp, Emericella nidulans
  modified_base (442)..(442): a, c, t or g
cattagaggaagtaaaagtcgtaacaaggtctccgttggtgaaccagcggagggatcattacagagttatctaactcccaaacccatgtgaacttacctttgttgcctcggcagtagttgctgggcgagcctacccgggaacgagctaccctgtagcgagttaccctggaacgacttaccctgtaacgcctgccggtggactactaaactcttgttatttttaagtaatctgagcgtcttattttaataagtcaaaactttcaacaacggatctcttggttctggcatcgatgaagaacgcagcgaaatgcgataagtaatgtgaattgcagaattcagtgaatcatcgaatctttgaacgcacattgcgcccattagtattctagtgggcatgcctgttcgagcgtcatttcaacccttaagcctagcttagtatgggaancgactttactgtcgttcctcaaattcaacggcggatttatggcaatctctgaacgtagttaattttttcctcgtttttgaaatactataaacctcagccgctaaacccccaatttttttatggttgacctcggatcaggtaggaatacccgctgaacttaagcatatcaataagcggaggaa

SEQ ID NO: 1304 - DNA, 687 bp, Sporobolus virginicus
cgacttggaggttgtgcccttgaggcgtggcttccggagctaacgcgttaagtcgaccccctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgagtagggctacacacgtgctacaatggcgcgtacaaagagaagcgacctcgcgagagcaggcggacctcataaagtgcgtcgtagtccggattggagtctgcaactcgaccccatgaagtcggaatcgctagtaatcgtagatcagaatgctacggtgaatacgttcccgggacttgtacacaccgcccgtcacaccatgggagtgggttgcaaaagaagtaagtagcttaaccttcgggagggcgcttaccacttcgtgattcatgactggggtgaagtcgtaacaaggtacc

SEQ ID NO: 1305 - DNA, 504 bp, Cochliobolus sp.
cagtagttgctgggcgagcctacccgggaacgagctaccctgtagcaagttaccctggaacgacttaccctgtaacgcctgccggtggactactaaactcttgttatttttaagtaatctgagcgtcttattttaataagtcaaaactttcaacaacggatctcttggttctggcatcgatgaagaacgcagcgaaatgcgataagtaatgtgaattgcagaattcagtgaatcatcgaatctttgaacgcacattgcgcccattagtattctagtgggcatgcctgttcgagcgtcatttcaacccttaagcctagcttagtattgggaatcgactttactgtcgttcctcaaattcaacggcggatttatagcaatctctgaacgtagtaatttttttcctcgtttttgaaatactataaacctcagccgctaaacccccaatttttttatggttgacctcggatcaggtaggaatacccgctgaacttaagcatatcaata

SEQ ID NO: 1306 - DNA, 562 bp, Cladosporium sp.
tcttggtcatttagaggaagtaaaagtcgtaacaaggtttccgtaggtgaacctgcggaaggatcattacctagagttgtaggctttgcctgctatctcttacccatgtcttttgagtaccttacgtttcctcggcgggtccgcccgccggttggacatacctaaaccctttgcagttgaaatcagcgtctgaaaaaacttaatagttacaactttcaacaacggatctcttggttctggcatcgatgaagaacgcagcgaaatgcgataagtagtgtgaattgcagaattcagtgaatcatcgaatctttgaacgcacattgcgccccttggtattccatggggcatgcctgttcgagcgtcatttgtaccttcaagctctgcttggtgttgggtgtttgtctcgtgtagactcgcctcaaaacaattggcagccggcgtattgatttcggagcgcagtacatctcgcgctttgcactcataacgacgacgtccaaaagtacattttttacgcttgacctcggatcaggtagggatacccgctgaacttaagcatatcata

SEQ ID NO: 1307 - DNA, 590 bp, Phoma sorghina
ttagaggaagtaaaagtcgtaacaaggtctccgtaggtgaacctgcggagggatcattacacaaatacaatatgaaggcttcggctggattatttatttcacccttgtcttttgcgcacttgttgttacctgggcgggttcgcccgccaccaggaccacaccataaaccttttttgtttaatgcattcagcgtcagtataacaaatgtaaatcatcctacaactttcaacaacggatctcttggttctggcatcgatgaagaacgcagcgaaatgcgatacgtagtgtgaattgcagaattcagtgaatcatcgaatctttgaacgcacattgcgccctttggtattccaaagggcatgcctgttcgagcgtcatttgtaccctcaagctttgcttggtgttgggcgtcttgtctttgttctccaaagactcgccttaaaacgattggcagccgacctcctggtttcgcagcgcagcacaattttgcgcttgcaatcagcaacagaggttggcactccatgaagcctttttttcttacgtttgacctcggatcaggtagggatacccgctgaacttaagcatatcaataa

SEQ ID NO: 1308 - DNA, 558 bp, Phoma sp.
tgcggagggatcattacacaataaaatacgaaggccgttcgcggctggactatttattacccttgtcttttgcgcacttgttgtttcctgggcgggttcgctcgccaccaggaccacaatataaaccttttttatgcagttgcaatcagcgtcagtacaacaaatgtaaatcatttacaactttcaacaacggatctcttggttctggcatcgatgaagaacgcagcgaaatgcgatacgtagtgtgaattgcagaattcagtgaatcatcgaatctttgaacgcacattgcgccctttggtattccaaagggcatgcctgttcgagcgtcatttgtaccctcaagctttgcttggtgttgggcgtttttgtcccccccaaaaaaggggactcgccttaaaaggattggcagccggcctactggtttcgcagcgcagcacatttttgcgcttgcaatcagcaaaagaggacggcaatccatcaagactccttctcacgtttgacctcggatcacgtagggataccctctgaacttaagcatatcaataagcggaggaa

SEQ ID NO: 1309 - DNA, 601 bp, Bartalinia robillardoides
ttttggccatttagaggaagtaaaagtcgtaacaaggtctccgtaggtgaacctgcggagggatcattacacaataaaatacgaaggccgttcgcggctggactatttattacccttgtcttttgcgcacttgttgtttcctgggcgggttcgctcgccaccaggaccacaatacaaaccttttttatgcagttgcaatcagcgtcagtacaacaaatgtaaatcatttacaactttcaacaacggatctcttggttctggcatcgatgaagaacgcagcgaaatgcgatacgtagtgtgaattgcagaattcagtgaatcatcgaatctttgaacgcacattgcgccctttggtattccaaagggcatgcctgttcgagcgtcatttgtaccctcaagctttgcttggtgttgggcgtttttgtcccccccaaaaaggggactcgccttaaaaggattggcagccggcctactggtttcgcagcgcagcacatttttgcgcttgcaatcagcaaaagaggacggcaatccatcaagactccttctcacgtttgacctcggatcaggtagggatacccgctgaacttaagcatatcaataa

SEQ ID NO: 1310 - DNA, 444 bp, Bartalinia pondoensis
aaaaagggacggcccgcccgaggacccctaaactctgtttttagtggaacttctgagtaaaacaaacaaataaatcaaaactttccaacaacggatgctcttggttctggcatcgatgaagaacgcagcaaaatgcgaataaggtaatgtgtaattgcagaattcagtgaatcatcgaatctttgaacgcacattgcgcccgccagtattctggcgggcatgcctgttcgagcgtcatttcaaccctcaagctcagcttggtgttgggactcgcggtaacccgcgttccccaaatcgattggcggtcacgtcgagcttccatagcgtagtaatcatacacctcgttactggtaatcgtcgcggccacgccgtaaaaccccaacttctgaatgttgacctcggatcaggtaggaatacccgctgaacttaagcatatcaataagg

SEQ ID NO: 1311 - DNA, 611 bp, Dothideomycete sp.
tttggtcatttagaggaagtaaaagtcgtaacaaggtctccgttggtgaaccagcggagggatcattacagagttgccatctcggctctccaacccactgtgaacatacctatcgttccctcggcgggcccagcgcgcgttgcctccgggctccgggcgtccgccggggacaaccaaaccctgattttattgtgaatctctgaggggcgagagcccgaaaacaaaatgaatcataactttcaacaacggatctcttggttctggcatcgatgaagaacgcagcgaaatgcgataagtaatgtgaattgcagaattcagtgaatcatcgaatctttgaacgcacattgcgcccgccggcactccggcgggcatgcctgtccgagcgtcatttcaaccctcagggaccccttccggggggcacctggtgctggggatcagcggcctccgggcccctgtcccccaaatgcagtggcggtcgcgccgcagcctcccctgcgtagtagcacacctcgcaccggagagcggctcggccacgccgtgaaacccccaactttcacaaggttgacctcggatcaggtaggaatacccgctgaacttaagcatatcaataa

SEQ ID NO: 1312 - DNA, 687 bp, Chloris barbata
cgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcggtccggccgggaactcaaaggagactgccggtggtaaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgtgagggcgcttaccactttgtgattcgtgactggggtgaagtcgtaacaaggtaac

SEQ ID NO: 1313 - DNA, 509 bp, Cochliobolus hawaiiensis
ttacctagagttgtaggctttgcctgctatatcttacccatgtcttttgagtacctttcgtttcctcggcgggtccgcccgccgattggacacattcaaaccctttgcagttgcaatcagcgtctgaaaaaacttaatagttacaactttcaacaacggatctcttggttctggcatcgatgaagaacgcagcgaaatgcgataagtagtgtgaattgcagaattcagtgaatcatcgaatctttgaacgcacattgcgccccttggtattccatggggcatgcctgttcgagcgtcatttgtaccttcaagctctgcttggtgttgggtgtttgtctcgcctctgcgcgcagactcgcctcaaaacaattggcagccggcgtattgatttcggagcgcagtacatctcgcgctttgcactcataacgacgacgatccaaaagtacattttttacactcttgacctcggatcaggtagggatacccgctgaacttaagcatatcaataa

SEQ ID NO: 1314 - DNA, 615 bp, Cochliobolus sp.
tcttggtcatttagaggaagtaaaagtcgtaacaaggtctccgttggtgaaccagcggagggatcattacagagttgcaaaactcccacaaaccatcgcgaatcttacccgtacggttgcctcggcgctggcggtccggaaggccctcgggcccccggaccctcgggtctcccgctcgcgggaggctgcccgccggagtgccgaaaccaaactcttgatattttatgtctctctgagtaaacttttaaataagtcaaaactttcaacaacggatctcttggttctggcatcgatgaagaacgcagcgaaatgcgataagtaatgtgaattgcagaattcagtgaatcatcgaatctttgaacgcacattgcgctcgccagtattctggcgagcatgcctgttcgagcgtcatttcaaccatcaagctctgcttgcgttggggatccgcggctgcccgcggtccctcaaaaacagtggcgggctcgctagtcacaccgagcgtagtaactctacatcgctatggtcgtgcggcgggttcttgccgtaaaacccccaatttctaaggttgacctcggatcaggtaggaatacccgctgaacttaagcatatcaataa

SEQ ID NO: 1315 - DNA, 496 bp, Fusarium sp.
ttatttcacccttgtcttttgcgcacttgttgtttcctgggcgggttcgcccgccaccaggaccacaccataaaccttttttgtttaatgcattcagcgtcagtataacaaatgtaaatcatttacaactttcaacaacggatctcttggttctggcatcgatgaagaacgcagcgaaatgcgatacgtagtgtgaattgcagaattcagtgaatcatcgaatctttgaacgcacattgcgccctttggtattccaaagggcatgcctgttcgagcgtcatttgtaccctcaagctttgcttggtgttgggcgtcttgtctttgttctccaaagactcgccttaaaacgattggcagccgacctcctggtttcgcagcgcagcacaattttgcgcttgcaatcagcaacagaggttggcactccatgaagcctttttttcttacgtttgacctcggatcaggtagggatacccgctgaacttaagcatatcaataa

SEQ ID NO: 1316 - DNA, 514 bp, Nectria sp.
cggcggaggggtgccacagcctgactttatacccaccctttgcctatgtgtacccctattgcttccctcggcgggttcgcccgccgacaggaacctactaaaccctttgcattatacatttaacacttccgatacaaaactaaattattacaacttttaacaatggatctcttggttctggcatcgatgaagaacgcagcgaaatgcgataagtagtgtgaattgcagaattcagtgaatcatcgaatctttgaacgcacattgcgcccctcggtattccggggggcatgcctgttcgagcgtcatttacaccctcaagctctgcttggtgttgggcgtctgtcccgcctccgtgcgcggactcgcctcaaagtcattggcagcggtctcgtcggcttctcgcgcagcacatttgcgcttctcggagccccggcggatcagcgtccagcaagcaatttcatgacttgacctcggatcaggtagggatacccgctgaacttaagcatatcaataa

SEQ ID NO: 1317 - DNA, 574 bp, Phoma sp.
tagaggaagtaaaagtcgtaacaaggtctccgttggtgaaccagcggagggatcattacagagttatccaactcccaaacccatgtgaacttatctctttgttgcctcggcgcaagctacccgggacccagcgccccgggcggcccgccggcggacaaaccaaactcttgttatcttagttgattatctgagcgtcttatttaataagtcaaaactttcaacaacggatctcttggttctggcatcgatgaagaacgcagcgaaatgcgataagtaatgtgaattgcagaattcagtgaatcatcgaatctttgaacgcacattgcgcccattagtattctagtgggcatgcctgttcgagcgtcatttcaacccctaagcacagcttactgttgggactctacggcctccgtagttccccaaagcgattggcggagtggcagtagtcctctgagcgtagtaattctttatctcgcttttgttaggtgctgcccccccggccgttaaaccccccaattttttctggttgacctcggatcaggtaggaatacccgctgaacttaagcatatcata

SEQ ID NO: 1318 - DNA, 587 bp, Sordaria tomento alba
agaggaagtaaaagtcgtaacaaggtctccgtaggtgaacctgcggagggatcattacacaataaaatacgaaggccgttcgcggctggactatttattacccttgtcttttgcgcacttgttgtttcctgggcgggttcgctcgccaccaggaccaccatataaaccttttttatgcagttgcaatcagcgtcagtataacaaatgtaaatcatttacaactttcaacaacggatctcttggttctggcatcgatgaagaacgcagcgaaatgcgatacgtagtgtgaattgcagaattcagtgaatcatcgaatctttgaacgcacattgcgccctttggtattccaaagggcatgcctgttcgagcgtcatttgtaccctcaagctttgcttggtgttgggcgtttttgtccccctaacaagggactcgccttaaaaggattggcagccggcctactggtttcgcagcgcagcacatttttgcgcttgcaatcagcaaaagaggacggcaatccatcaagactccttctcacgtttgacctcggatcaggtagggatacccgctgaacttaagcatatcaataa

SEQ ID NO: 1319 - DNA, 687 bp, Cenchrus spinifex
cgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtacc

SEQ ID NO: 1320 - DNA, 685 bp, Cenchrus spinifex
atactaggtgtaggggttgtcatgacctctgtgccgccgctaacgcattaagtattccgcctggggagtacggtcgcaagattaaaactcaaaggaattgacgggggcccgcacaagcagcggagcatgtggtttaattcgaagcaacgcgaagaaccttacctagacttgacatctcctgaattacccttaatcggggaagcccttcggggcaggaagacaggtggtgcatggttgtcgtcagcccgtgtcgtgagatgttgggttaagtcccgcaacgagcgcaacccttattgttagttgctaccatttagttgagcactctagcgagactgcccgggttaaccgggaggaaggtggggatgacgtcaaatcatcatgccccttatgtctagggctacacacgtgctacaatggctggtacagagagatgctaaaccgcgaggtggagccaaactttaagaccagtctcagttcggattgtaggctgaaactcgcctacatgaagctggagttgctagtaatcgcgaatcagaatgtcgcggtgaatacgttcccgggccttgtacacaccgcccgtcacaccatgagagttggcaatacccaaagttcgtgagctaacgcgtaagcggggcagcgacctaaggtagggtcagcgattggggtgaagtcgtaacaaggtaac

SEQ ID NO: 1321 - DNA, 570 bp, Nigrospora oryzae
tttggtcatttagaggaagtaaaagtcgtaacaaggtttccgtaggtgaacctgcggaaggatcattatcaaaacagcggacttcggtccttgctgcacccttgtcttttgcgtaccgtatgtttcctcggcgggcttgcctgccggttggacattatcaaacctttttgtagttgcaatcagcgtcagaaaataataataattacaactttcaacaacggatctcttggttctggcatcgatgaagaacgcagcgaaatgcgaaaagtagtgtgaattgcagaattcagtgaatcatcgaatctttgaacgcacattgcgccccttggtattccatggggcatgcctgttcgagcgtcattttgtaccctcaagcactgcttggtgttgggcgcttgtcctgcaaaggactcgcctgaaagcgattggcggccaacgtactggtggtagagcgcagcacaatttgcgtctttcccctctgcgttagcgtccataaagcctatttcaacgtttgacctcggatcaggtagggatacccgctgaacttaagcatatcaataagcggaggaa

SEQ ID NO: 1322 - DNA, 469 bp, Cochliobolus australiensis
tgaggaagtaaaagtcgtaacaaggtttccgtaggtgaacctgcggaaggatcattacctagagttgtaggctttgcctgctatctcttacccatgtcttttgagtaccttcgtttcctcggcgggtccgcccgccgattggacatacttaaaccctttgtaattgaaatcagcgtctgaaaaacttttaatagttacaactttcaacaacggatctcttggttctggcatcgatgaagaacgcagcgaaatgcgataagtagtgtgaattgcagaattcagtgaatcatcgaatctttgaacgcacattgcgccccttggtattccatggggcatgcctgttcgagcgtcatttgtaccttcaagctttgcttggtgttgggtgtttgtctcgcctctgcgcgcagactcgcctcaaaacaattggcagccggcgtattgatttcggagcgcagtacatctcgcgctc

SEQ ID NO: 1323 - DNA, 511 bp, Phoma leveillei
tacctagagttgcgggctttgcctgccatctcttacccatgtcttttgagtaccttacgtttcctcggtgggttcgcccgccggctggacaacattcaaaccctttgtagttgcaatcagcgtctgaaaaacttttaatagttacaactttcaacaacggatctcttggttctggcatcgatgaagaacgcagcgaaatgcgataagtagtgtgaattgcagaattcagtgaatcatcgaatctttgaacgcacattgcgccccttggtattccatggggcatgcctgttcgagcgtcatttgtaccttcaagctctgcttggtgttgggtgtttgtctcgccttttgcgcgcagactcgcctcaaaacgattggcagccggcgtattgatttcggagcgcagtacatctcgcgctttgcactcataacgacgacgtccaaaaagtacattttttacactcttgacctcggatcaggtagggatacccgctgaacttaagcatatcaataa

SEQ ID NO: 1324 - DNA, 554 bp, Phoma sp.
tatgaggggtgggtttgctggcaacagcgtccgccccaagtattttttcacccatgtcttttgcgcactttttgtttcctgggcgagttcgctcgccaccaggacccaaccataaacctttttttatgcagttgcaatcagcgtcagtataataattcaatttattaaaactttcaacaacggatctcttggttctggcatcgatgaagaacgcagcgaaatgcgatacgtagtgtgaattgcagaattcagtgaatcatcgaatctttgaacgcacattgcgccctttggtattccaaagggcatgcctgttcgagcgtcatttgtaccctcaagcttgacttggtgttgggcgtctttttgtctctccccttgttgggggagactcgccttaaaacgattggcagccgacctactggttttcggagcgcagcacaaatttgcgccttccaatccacggggcggcatccagcaagcctttgttttctataacaaatccacattttgacctcggatcaggtagggatacccgctgaacttaagcatatcaataa

SEQ ID NO: 1325 - DNA, 571 bp, Didymella sp.
tttggtcatttagaggaagtaaaagtcgtaacaaggtttccgtaggtgaacctgcggaaggatcattaccgagttttcgggcttcggctcgactctcccaccctttgtgaacgtacctctgttgctttggcggctccggccgccaaaggacctccaaactccagtcagtaaacgcagacgtctgataaacaagttaataaactaaaactttcaacaacggatctcttggttctggcatcgatgaagaacgcagcgaaatgcgataagtaatgtgaattgcagaattcagtgaatcatcgaatctttgaacgcacattgcgccccttggtattccggggggcatgcctgttcgagcgtcattacaaccctcaagctctgcttggaattgggcaccgtcctcactgcggacgcgcctcaaagacctcggcggtggctgttcagccctcaagcgtagtagaatacacctcgctttggagtggtgggcgtcgcccgccggacgaaccttctgaacttttctcaaggttgacctcggatcaggtagggatacccgctgaacttaagcatatcaata

SEQ ID NO: 1326 - DNA, 608 bp, Exserohilum rostratum
gtcgtaacaaggtctccgtaggtgaacctgcggagggatcattacacaaaagaatatgaaggctgactgcggctgcgcttcacggccagtttgctgaggctgaattattttttcacccatgtcttttgcgcacttgttgtttcctgggcgggtacgcacgccaccaggaccccaccataaacctttttatctgtagttgcaatcagcgtcagtaacaagtaaataatcatttacaactttcaacaacggatctcttggttctggcatcgatgaagaacgcagcgaaatgcgatacgtagtgtgaattgcagaattcagtgaatcatcgaatctttgaacgcacattgcgccctttggtattccaaagggcatgcctgttcgagcgtcatttgtaccctcaagctttgcttggtgttgggcgtttttgtctttggctacagcccaaagactcgccttaaaacgattggcagccggcctactggtttcgcagcgcagcacatttttgcgcttgcaaccagcaaaagaggttggcaatccatcaagtcttactttctcacttttgacctcggatcaggtagggataccccgctgaacttaagcatatcaat

SEQ ID NO: 1327 - DNA, 585 bp, Lasiodiplodia pseudotheobromae
tttggtcatttagaggaagtaaaagtcgtaacaaggtctccgttggtgaaccagcggagggatcattaccgagtttacaactcccaaacccctgtgaacatacctatacgttgcctcggcggatcagcccgcgccccgtaaaacgggacggcccgcccgaggacccctaaactctgtttttagtggaacttctgagtaaaacaaacaaataaatcaaaactttcaacaacggatctcttggttctggcatcgatgaagaacgcagcaaaatgcgataagtaatgtgaattgcagaattcagtgaatcatcgaatctttgaacgcacattgcgcccgccagtattctggcgggcatgcctgttcgagcgtcatttcaaccctcaagctcagcttggtgttgggactcgcggtaacccgcgttccccaaatcgattggcggtcacgtcgagcttccatagcgtagtaatcatacacctcgttactggtaatcgtcgcggccacgccgtaaaaccccaacttctgaatgttgacctcggatcaggtaggaatacccgctgaacttaagcatatcaataagcggaggaa

SEQ ID NO: 1328 - DNA, 458 bp, Curvularia sp.
tcggcggatcagcccgcgccctgtaaaacgggacggcccgcccgaggaccctaaactctgtttttagtggaacttctgagtaaaacaaacaaataaatcaaaactttcaacaacggatctcttggttctggcatcgatgaagaacgcagcaaaatgcgataagtaatgtgaattgcagaattcagtgaatcatcgaatctttgaacgcacattgcgcccgccagtattctggcgggcatgcctgttcgagcgtcatttcaaccctcaagctcagcttggtgttgggactcgcggtaacccgcgttccccaaatcgattggcggtcacgtcgagcttccatagcgtagtaatcatacacctcgttactggtaatcgtcgcggccacgccgtaaaaccccaacttctgaatgttgacctcggatcaggtaggaatacccgctgaacttaagcatatcaat

SEQ ID NO: 1329 - DNA, 576 bp, Fusarium equiseti
attcattacacaaaaaaatatgaaaggtgactgcagatgacctacatggccagtttgctagaggctgaattatttatcaccccatataatttgcgcacttgttgtttcctgggcgggttaaaacaaacaccaggaccacaccataaacctttttatctgtagttgcaatcagcgtcagtaacaagtaaataatcatttacaactttcaacaacggatctcttggttctggcatcgatgaagaacgcagcgaaatgcgatacgtagtgtgaattgcagaattcagtgaatcatcgaatctttgaacgcacattgcgccctttggtattccaaagggcaagcctgttcgagcgtcatttgtaccctcaagctttgcttggtgttgggcgtttttgtctttggctacagcccgaagactcgccttaaaacgattggcagccggcctactggtttcgcagcgcagcacatttttgcgcttgcaatcagcaaaagaggttggcgatccatcaagtcttactttctcacttttgacctcggatcaggtagggatacccccctgaacttaagcatatcaataa

SEQ ID NO: 1330 - DNA, 581 bp, Fusarium sp.
ccgttggtgaaaccagcggagggatcattactggggtttacgctcttcaaccctttgtgaacatacctataactgttgaaaaaaaagggtagggtctccgcgaccctcccggccaaaaaaactccgggcgggtcggcgcccgcggggaggataaccaaaactctgatttaacgacgtttcttctgagtggtacaagcaaataatcaaaacttttaacaacggatctcttggttctggcatcgatgaagaacgcagcgaaatggagaaagtaatgtgaattgcagaattcagtgaatcatcgaatctttgaacgcacattgcgcccgccagcattatggcgggcatgcctgttcgagcgtcatttcaaccctcaagctctgcttggtgttggggccctacagctgatgtaggccctcaaaggtagtggcggaccctcccggagcctcctttgcgtagtaactttacgtctcgcactgggatccggagggactcttgccgtaaaaccccccaattttccaaaggttgacctcggatcaggtaggaatacccgctgaacttaagcatatcaataagcggaggaa

SEQ ID NO: 1331 - DNA, 681 bp, Eleocharis atropurpurea
caactagttgtcgggtcttcattgacttggtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtatggaatcctgctgagaggtgggagtgcccgaaagggagccataacacaggtgctgcatggctgtcgtcagctcgtgtcgtgagatgttgggttaagtcccgcaacgagcgcaacccttgtccctagttgctacgcaagagcactctagggagactgccggtgacaaaccggaggaaggtggggatgacgtcaagtcctcatggcccttatgggtggggcttcacacgtcatacaatggtcggaacagagggtcgccaacccgcgagggggagccaatcccagaaaaccgatcgtagtccggatcgcactctgcaactcgagtgcgtgaagctggaatcgctagtaatcgcggatcagcatgccgcggtgaatacgttcccgggtcttgtacacaccgcccgtcacaccatggggtgggttttaccagaagtggctagtctaaccgcaaggaggacggtcaccacggtaggattcatgactggggtgaagtcgtaacaaggtacc

SEQ ID NO: 1332 - DNA, 552 bp, Eleocharis atropurpurea
cggagctaacgcgttaagtcgaccgcctggggagtacggccgcaagattaaaactcaaaggaattgacggggacccgcacaagcggtggatgatgtggattaattcgatgcaacgcgaaaaaccttacctacccttgacatgtatggaatcctgctgagaggtgggagtgcctgaaagggagccataacacaggtgctgcatggctgtcgtcagctcgtgtcgtgagatgttgggttaagtcccgcaacgagcgcaacccttgtccctagttgctacgcaagagcactctagggagactgccggtgacaaaccggaggaaggtggggatgacgtcaagtcctcatggcccttatgggtagggcttcacacgtcatacaatggtcggaacagagggtcgccaacccgcgagggggagccaatcccagaaaaccgatcgtagtccggatcgcactctgcaactcgagtgcgtgaagctggaatcgctagtaatcgcggatcagcatgccgcggtgaatatgtacccgggccctgtacacaccgcccgtcacacc

SEQ ID NO: 1333 - DNA, 566 bp, Acremonium strictum
tccgttggtgaaccagcggagggatcattaccagagtgccctaggctctccaacccattgtgaacttaccaaacgttccctcggcgggctcagcgcgcggtggcctccgggcctccgggcgtccgccggggaaaaccaaaccctgatttaatcgtatttctctgaggggcgaaagcccgaaaacaaaatgaatcaaaactttcaacaacggatctcttggctctggcatcgatgaagaacgcagcgaaatgcgataagtaatgtgaattgcagaattcagtgaatcatcgaatctttgaacgcacattgcgcccgccggcactccggcgggcatgcctgtccgagcgtcatttcaaccctcaggcccacccttccgggggagcgggcctggtgctggggatcggcggccctcgcggcccccgtccctcaaatacagtggcggtcgcgccgcagcctcccctgcgtagtagcacaacctcgcaccggagagcggaacgaccacgccgtgaaacccccaattttttaaggttgacctcggatcaggtaggaatacccgctgaacttaa

SEQ ID NO: 1334 - DNA, 1488 bp, Alternaria teniussima
acaggtctgtgatgcccttagatgttctgggccgcacgcgcgctacactgacagagccaacgagttcttttccttgttcgaaagaattgggtaatcttgttaaactctgtcgtgctggggataaagcattgcaattattgcttttcaacgaggaatgcctagtaagcgcgtgtcatcagcatgcgttgattacgtccctgacctttgtacacaccgcccgtcgctactaccgattgaatggctcagtgaggccttcggactggctcgaggaggttggcaacgaccacctcaagccggaaagttcgtcaaactcggtcatttagaggaagtaaaagtcgtaacaaggtctccgtaggtgaacctgcggagggatcattacacaaatatgaaggcgggctggaacctctcggggttacagccttgctgaattattcacccttgtcttttgcgtacttcttgtttccttggtgggttcgcccaccactaggacaaacataaaccttttgtaattgcaatcagcgtcagtaacaaattaataattacaactttcaacaacggatctcttggttctggcatcgatgaagaacgcagcgaaatgcgataagtagtgtgaattgcagaattcagtgaatcatcgaatctttgaacgcacattgcgccctttggtattccaaagggcatgcctgttcgagcgtcatttgtaccctcaagctttgcttggtgttgggcgtcttgtctctagctttgctggagactcgccttaaagtaattggcagccggcctactggtttcggagcgcagcacaagtcgcactctctatcagcaaaggtctagcatccattaagcctttttttcaacttttgacctcggatcaggtagggatacccgctgaacttaagcatatcaataagcggaggaaaagaaaccaacagggattgccctagtaacggcgagtgaagcggcaacagctcaaatttgaaatctggctcttttagagtccgagttgtaatttgcagagggcgctttggctttggcagcggtccaagttccttggaacaggacgtcacagagggtgagaatcccgtacgtggtcgctggctattgccgtgtaaagccccttcgacgagtcgagttgtttgggaatgcagctctaaatgggaggtacatttcttctaaagctaaatattggccagagaccgatagcgcacaagtagagtgatcgaaagatgaaaagcactttggaaagagagtcaaacagcacgtgaaattgttgaaagggaagcgcttgcagccagacttgcttacagttgctcatccgggtttctacccggtgcactcttctgtaggcaggccagcatcagtttgggcggtaggataaaggtctctgtcacgtacctcctttcggggaggccttataggggagacgacatactaccagcctggactgaggtccgcgcatctgctaggatgctggcgtaatggctgtaa

SEQ ID NO: 1335 - DNA, 596 bp, Arthrinium sacchari
agtcgtaacaaggtctccgttggtgaaccagcggagggatcattacagagttatacaactcccataccatctgttaacctacccagttatgcctcggcgtaagctcggttggaggcacctgcagctaccctgtagttgcggactgccaactccagccgcggcccgccggcggtacactaaactctgttttattttatattctgagcgtcttattttaataagttaaaactttcaacaacggatctcttggttctggcatcgatgaagaacgcagcgaaatgcgataagtaatgtgaattgcagaattcagtgaatcatcgaatctttgaacgcacattgcgcccatcagtattctggtgggcatgcctgttcgagcgtcatttcaacccttaagcctagcttagtgttgggaatctgctgtactgcagttccttaaagacagtggcggagcggcggtagtcctctgagcgtagtaatttatttctcgcttttgtcaggctctgtcctcccgccataaaacccccaattttttagtggttgacctcggatcaggtaggaatacccgctgaacttaagcatatcaataagcggaggaa

SEQ ID NO: 1336 - DNA, 539 bp, Bipolaris sorokiniana
gtaggtgaacctgcggagggatcattacacaacaaaatatgaaggcctggcttcgcggccggctgaaatatttttttcacccatgtcttttgcgcacttgttgtttcctgggcgggttcgcccgccaccaggaccaaaccataaaccttttttttatgcagttgcaatcagcgtcagtaaaaacaatgtaattattacaactttcaacaacggatctcttggttctggcatcgatgaagaacgcagcgaaatgcgatacgtagtgtgaattgcagaattcagtgaatcatcgaatctttgaacgcacattgcgccctttggtattccaaagggcatgcctgttcgagcgtcatttgtaccttcaagctttgcttggtgttgggcgttttttgtctccctctttctgggagactcgccttaaaacgattggcagccggcctactggtttcggagcgcagcacatattttgcgctttgtatcaggagaaaaggacggtaatccatcaagactctacatttttaacttttgacctcggatca

SEQ ID NO: 1337 - DNA, 1501 bp, Ceratobasidium sp.
  modified_base (26)..(26): a, c, t or g
  modified_base (29)..(29): a, c, t or g
  modified_base (586)..(586): a, c, t or g
  modified_base (1132)..(1132): a, c, t or g
  modified_base (1227)..(1236): a, c, t or g
  modified_base (1256)..(1256): a, c, t or g
  modified_base (1438)..(1438): a, c, t or g
ttgaatgagcatggagttggttgtcnctngccccttcactggggcatgtgcacgccttctctattcatccacacacacctgtgaacttgtgagacggatagtagtcccctcggggacgagctccgtctgctatacataaactccagtaaataaatttgaatgtcatttgatgtaacgcatctataaactaagtttcaacaacggatctcttggctctcgcatcgatgaagaacgcagcgaaatgcgataagtaatgtgaattgcagaattcagtgaatcatcgaatctttgaacgcaccttgcgctccttggtattcctcggagcatgcctgtttgagtatcatgaaattctcaaaataaatcttttgtttattcaattggtttcattttggacttggaggtctgcagattcacgtctgctcctcttaaattcattagctggatctctataaacttggttccactcggcgtgataagtatcactcgctgaggacactgtaaaaggtggccaggattgtggaagaactgcttccaatattccattcacttggacaatatacttatgatctgatctcaaatcaggtangactacccgctgaacttaagcatatcaataagcggaggaaaagaaactaacaaggattcccctagtaacggcgagtgaagcgggaagagctcaaatttaaaatctggcgggttaaccgtccgagttgtagtctagagaagtatcatcgacgctggaccatgtacaagtctcttggaacagagcgtcatagagggtgagaatcccgtccttgacatggactcccagtgttttgtgttgtgctctctacgagtcgagttgtttgggaatgcagctcaaaatgggtggtaaattccatctaaagctaaatattggcgagagaccgatagcgaacaagtaccgtgagggaaagatgaaaagcactttggagagagagttaaacagtacgtgaaattgttgaaatggaaacgcttgaagtcagtcgcgttctctgggattcagccttgcttttgcttggtgcatttcctagtctacgggccagcatggattttgaccgtcggaaaagggctgggggaatgtggcacttcgggtgtgttatagccccttgtngcatgcgtcggttgggatcgaggacctcagtgcacgcttcggttgtgctttgatgctggcgtaatggctttaaacgacccgtcttgaaacacggnnnnnnnnnncagtcaacttctgctatgtntgggtgcaaaaccgagcgcgaaatgaaagtgataagttgggaacctcattagaggggcaccgacgcccggaccagaccttctgtgacggatccgaggtagagcatatatgttgggacccgaaagatggtgaactatgcctgcatagggtgaagccagaggaaactctggtggaggctcgtancgattctgacgtgcaaatcgatcgtcaaatgtgggtataggggcgaaagactaatcgaaccat

SEQ ID NO: 1338 - DNA, 718 bp, Chaetomium funicola
ggattcggaataatttcacatattattagccaagaaagaggtaaaaaggaggcatttggtgtcttaggaataatttatgccataatagctattggacttttaggttttgtagtatgggctcatcatatatttacagtaggaatagatgtagacacccgtgcttattttacttcagccactataattattgctgtacccactggtattaaaatttttagatgattagcaacctatcatggagcccaaattaatttaactccatcctcattatgagctattggttttattttccttttcacgatgggaggcttaaccggagtaatcctagctaattcttctattgatattattcttcatgatacttattatgtagtagctcattttcactatgttttatcaataggagcagtatttgctattctagcaggaattattcaatgattcccactattcacagggcttacccttaataataaatacttaaaaatccagtttgtaactatatttattggagtaaatttaaccttcttcccccaacattttttaggactaagaggcataccacgacgatactctgactatcctgacgcatattttatatgaaatattgtatcctcaatcggaagaataatctctctagtaagagtaatttattttatatttattatttgagaggctttttcagttaaacgtataaatctttcatctttaaatttat

SEQ ID NO: 1339 - DNA, 875 bp, Chaetomium globulosum
ttgttgaaagttttaactttttatagtttatgccactcagcaatgaaatcaaatttctagtaaaaaaaataaaagagttttagtggtaagactatgctgccggcagcttagagtttgccccccttcttccctttttaacaggaaacggggctcaaaaccaccaaagcagcgttcgtcttatagaagaagggtatgttcacacatggtttgtagagtacaaaaactcagtaatgatccctccgtaggtggacctgcggagggatcattactgagtttttgtactctacaaaccatgtgtgaacatacccttcttctataagacgaacgctgctttggtggttttgagccccgtttcctgttaaaaagggaagaaggggggcaaactctaagctgccggcagcatagtcttaccactaaaactcttttattttttttactagaaatttgatttcattgctgagtggcataaactataaaaagttaaaactttcaacaacggatctcttggctctagcatcgatgaagaacgcagcgaaatgcgataagtaatgtgaattgcagaattcagtgaatcatcgaatctttgaacgcacattgcgcctggcagtattctgccaggcatgcctgtccgagcgtcatttcaccactcaagaaatacttttttttttttcttggtgttggaggtcctgttctttactgagcaggccgccgaaatgtatcggctgttatacttgccaactcccctgtgtagtactaaaatttattttttcacactttgaagttcctgtgtaacatgccgttaaaccctcaatatccaacttctgttgaattattattatttttttacaaggttgacctcggatcaggtaggaata

SEQ ID NO: 1340 - DNA, 524 bp, Cladosporium cladosporioides
tccgtaggtgaacctgcggagggatcattacaagaaacgaccccggttttaccaccgggtgatttcataaccctttgttgtccgactctgttgcctccggggcgaccctgccttcgggcgggggctccgggtggacaaattcaaactcttgcgtaactttgcagtctgagtaaatttaattaataaattaaaactttcaacaacggatctcttggttctggcatcgatgaagaacgcagcgaaatgcgataagtaatgtgaattgcagaattcagtgaatcatcgaatctttgaacgcacattgcgccccctggtattccggggggcatgcctgttcgagcgtcatttcaccactcaagcctcgcttggtattgggcgacgcggtccgccgcgcgcctcaaatcgaccggctgggtcttctgtcccctaagcgttgtggaaactattcgctaaagggtgctcgggaggctacgccgtaaaacaaccccatttctaaggttgacctcggatcaggtagggatacc

SEQ ID NO: 1341 - DNA, 568 bp, Cladosporium herbarum
aaaagtcgtaacaaggtctccgtaggtgaacctgcggagggatcattacaagaacgcccgggcttcggcctggttattcataaccctttgttgtccgactctgttgcctccggggcgaccctgccttcgggcgggggctccgggtggacacttcaaactcttgcgtaactttgcagtctgagtaaacttaattaataaattaaaacttttaacaacggatctcttggttctggcatcgatgaagaacgcagcgaaatgcgataagtaatgtgaattgcagaattcagtgaatcatcgaatctttgaacgcacattgcgccccctggtattccggggggcatgcctgttcgagcgtcatttcaccactcaagcctcgcttggtattgggcaacgcggtccgccgcgtgcctcaaatcgtccggctgggtcttctgtcccctaagcgttgtggaaactattcgctaaagggtgttcgggaggctacgccgtaaaacaaccccatttctaaggttgacctcggatcaggtagggatacccgctgaacttaagcatatcaataagcggagga

SEQ ID NO: 1342 - DNA, 590 bp, Cladosporium minourae
ttggtcaaacccggtcatttagaggaagtaaaagtcgtaacaaggtctccgtaggtgaacctgcggagggatcattacaagaacgcccgggcttcggcctggttattcataaccctttgttgtccgactctgttgcctccggggcgaccctgccttcgggcgggggctccgggtggacacttcaaactcttgcgtaactttgcagtctgagtaaacttaattaataaattaaaacttttaacaacggatctcttggttctggcatcgatgaagaacgcagcgaaatgcgataagtaatgtgaattgcagaattcagtgaatcatcgaatctttgaacgcacattgcgccccctggtattccggggggcatgcctgttcgagcgtcatttcaccactcaagcctcgcttggtattgggcaacgcggtccgccgcgtgcctcaaatcgtccggctgggtcttctgtcccctaagcgttgtggaaactattcgctaaagggtgttcgggaggctacgccgtaaaacaaccccatttctaaggttgacctcggatcaggtagggatacccgctgaacttaagcatatcaataac

SEQ ID NO: 1343 - DNA, 528 bp, Cordyceps cylindrica
cctgcggaaggatcattacagtgttccctgccctcacgggtagaaacgcccacccttgtataatatatcttgttgctttggcaggccgccctcgggtaccggcttcggctgggttcgcgcctgccagaggaccccaaactctgaatgttagtgtcgtctgagtactatataatagttaaaactttcaacaacggatctcttggttctggcatcgatgaagaacgcagcgaaatgcgataagtaatgtgaattgcagaattcagtgaatcatcgaatctttgaacgcacattgcgccccgtggtattccgcggggcatgcctgttcgagcgtcatttaaaccaatccagcttgctgggtcttgggcttcgcctccgggcgggcctcaaaatcagtggcggcgccacccggctctaagcgtagtaatacttctcgctacagagtcccgggtggaggctggccaacaacccccaatttttacaggttgacctcggatcaggtagggatacccgctgaacttaagcatatca

SEQ ID NO: 1344 - DNA, 563 bp, Epicoccum nigrum
aaaagtcgtaacaaggtttccgtaggtgaacctgcggaaggatcattacctagagtttgtagacttcggtctgctacctcttacccatgtcttttgagtaccttcgtttcctcggcgggtccgcccgccgattggacaacattcaaaccctttgcagttgcaatcagcgtctgaaaaaacataatagttacaactttcaacaacggatctcttggttctggcatcgatgaagaacgcagcgaaatgcgataagtagtgtgaattgcagaattcagtgaatcatcgaatctttgaacgcacattgcgccccttggtattccatggggcatgcctgttcgagcgtcatttgtaccttcaagctctgcttggtgttgggtgtttgtctcgcctctgcgtgtagactcgccttaaaacaattggcagccggcgtattgatttcggagcgcagtacatctcgcgctttgcactcataacgacgacgtccaaaagtacatttttacactcttgacctcggatcaggtagggatacccgctgaacttaagcatatcaataagcggaggaa

SEQ ID NO: 1345 - DNA, 646 bp, Fusarium avenaceum
tcgtcgtcatcggccacgtcgactctggcaagtcgaccactgtaagtacaaccatcagcgagtcgcttatctgcactcggaacccgccaaacctggcggggtatcaccacgacatcttgctaactcttgacagaccggtcacttgatctaccagtgcggtggtatcgacaagcgaaccatcgagaagttcgagaaggttagtcaatatcccttcgattacgcgcgctcccatcgattcccacgactcgctccctcattcgaaacgcattcattaccccgctcaagtccgaaaattttgcggtgcgaccgtgattttttttggtggggtatcttaccccgccactcgagtgacggatgcgcttgccctgttcccacaaaaccttaccacactgtcgcgcactatgtcttgcagtcactaaccactggacaataggaagccgccgagctcggaaagggttccttcaagtacgcctgggttcttgacaagctcaaagccgagcgtgagcgtggtatcaccattgatatcgctctctggaagttcgagactcctcgctactatgtcaccgtcattggtatgttgtcactgtctcacaccaccatgccttcatcatgctaacattcctctcagatgcccccggtcatcgtg

SEQ ID NO: 1346 - DNA, 650 bp, Fusarium flocciferum
tcgtcgtcatcggccacgtcgactctggcaagtcgaccactgtaagtacaaccatcagcgagtcgcttatctgcactcagagcctgccaaacctggcggggtattaccacaacagtttgctaacttttgatagaccggtcacttgatctaccagtgcggtggtatcgacaagcgaaccatcgagaagttcgagaaggttagtcaatatcccttcgattgcgcgctcccatcgatccccacgactcgctccttcactcgaaacgcatccattaccccgctcgagcccgaaaattttgcggtgcgaccgtgatttttttttggtggggtatcttaccccgccactcgagtgacggatgcgcttgccctgttcccacaaaaccttactaccctgccgcgcactatcatatgtcttgcagtcactaaccactggacaataggaagccgccgagctcggaaagggttccttcaagtacgcctgggttcttgacaagctcaaagccgagcgtgagcgtggtatcaccattgatatcgctctctggaagttcgagactcctcgctactatgtcaccgtcattggtatgttgtcactgtctcataccaccatgctttcatcatgctaacatccctctcagatgcccccggtcatcgtg

SEQ ID NO: 1347 - DNA, 693 bp, Fusarium poae
  modified_base (558)..(558): a, c, t or g
ctaacataggaaaaactacagtatactaaaatctctttcttccccccaccattctatatgggtaaggtcaagttgaaactaacattggacatagtcttgaaaagacacacacacacacacacacacacacacacacacaagcatacagagaaaagccacaaagtttcacgaaatctacaaggcatggcacttttagtttgctcctcctagttaactcttcaatcttctgtaacatgtctttttgctctgggaagaggacctgcatagaaaatatcacagagccccttgtcttttgccctttggtttggtcaagccaactcagagccccagcaggatataagagagaatgttgggcagagtgataaagtggtagtgggtatatttattctccaactccctttatgagaaatcaccttagattagcaggaccttccagcctaactaaaggtcacaatttgtctctaggtggtccctctctccaagcctcttctgatttatagaaaccactcccctccttagggtaccgagctcgaattcgtaatcatggtccatagctgnttcctgtgtgaaattgttatccgctcacaattccacacaacatacgagccggaagcataaagtgtaaagccctggggtgcctaatgagtgagctaactcacattaattgcgttgcgctcactgccccgctttcca

SEQ ID NO: 1348 - DNA, 407 bp, Fusarium reticulatum
  modified_base (278)..(278): a, c, t or g
  modified_base (284)..(285): a, c, t or g
  modified_base (292)..(292): a, c, t or g
  modified_base (302)..(302): a, c, t or g
  modified_base (312)..(312): a, c, t or g
  modified_base (319)..(319): a, c, t or g
  modified_base (326)..(326): a, c, t or g
  modified_base (340)..(340): a, c, t or g
  modified_base (342)..(342): a, c, t or g
  modified_base (344)..(344): a, c, t or g
  modified_base (372)..(372): a, c, t or g
ctttgcgcccctgattctaccccgctgggtggtagcagctcaacaacaatgcacgacagctcgcagcttgagcttgatcaacaaccttgtgctggaacatgagactaaccatatcttttctttgcaataggttcatcttcagaccggtcagtgcgtaagtactcgttgctccaacgtcatccatgagggatgctaacaatgttgattagggtaaccaaattggtgctgctttctggcagactatctctggcgagcatggtcttgacagcaatggtgtntacaanngcacctnggagcttcanctcgagcgcntgagcgnctacttnaacgaggtatgttncngncagttaattccaagaaaactgtaggctnacgcaaataggcttccggcaacaagtacgtccctc

SEQ ID NO: 1349 - DNA, 646 bp, Fusarium sporotrichioides
tcgtcgtcatcggccacgtcgactctggcaagtcgaccactgtgagtacatctgcatcacaaccccgcccagacttggcggggtagtttcaatcatcatttttactgacatgctttgacagaccggtcacttgatctaccagtgcggtggtatcgacaagcgaaccatcgagaagttcgagaaggttggtctcattttcctcgatcgcgcgcccttcttcccatcgacccatcattcgaatcgctctcatacgacgactcgacaagcgcctgttaccccgctcgagttcaaaatttttacggctgtgtcgtgattttttttgatagtggggctcataccccgccgctcgagtgacaggcgcttttgcccttcccacacatccatttacatgggcgcgcatcatcacgtgtcaatcagtcactaaccacctgtcaataggaagccgccgagctcggtaagggttccttcaagtacgcctgggttcttgacaagctcaaagccgagcgtgagcgtggtatcaccattgatatcgctctctggaagttcgagactcctcgctactatgtcaccgtcattggtatgttgtcactattgccttcatcacattctcatactaacatgcctaccagacgctcccggtcaccgt

SEQ ID NO: 1350 - DNA, 652 bp, Fusarium torulosum
tcgtcgtcatcggccacgtcgactctggcaagtcgaccactgtaagtacaaccatcagcgagttgcttacctgcactcggagtctgccaaacctggcggggtattatcacaacattttgctaacttttgacagaccggtcacttgatctaccagtgcggtggtatcgacaagcgaaccatcgagaagttcgagaaggttagtcaaaatcccttcgattgcgcgcgctcccatcgattcctacgactcgctccctcactcgaaacgcatccattaccccgctcgagcccgaaaattttgcggtgcgaccgtgatttttttttggtggggtatcttaccccgccactcgagtgacggatgcgcttgccctgttcccacaaaaccttactaccctgtcgcgcactatcatatgtcttccagtcactaaccactggacaataggaagccgccgagctcggaaagggttccttcaagtacgcctgggttcttgacaagctcaaagccgagcgtgagcgtggtatcaccattgatatcgctctctggaagttcgagactcctcgctactatgtcaccgtcattggtatgttgtcactgtctcataccaccatgctttcaccatgctaacatctctctcagatgcccccggtcatcgtg

SEQ ID NO: 1351 - DNA, 649 bp, Fusarium tricinctum
tcgtcgtcatcggccacgtcgactctggcaagtcgaccactgtaagtacaaccatcagcgggttgcttatatgcactcggaatccgccaaacctggcggggtatcaccacaacattttgctaacttttgacagaccggtcacttgatctaccagtgcggtggtatcgacaagcgaaccatcgagaagttcgagaaggttagtcaatatcccttcgattacgcgcgctcccatcgattcccacgattcgctccctcactcgaaacgcatccattaccccgctcgagcccgagaattttgcggtgcgaccgtgatttttttctggtggggtatcttaccccgccactcgagtgacggatgcgcttgccctgttcccacaaaaccttaccaccctgtcgcgcactacatgtcttgcagtcactaaccactggacaataggaagccgccgagctcggaaagggttccttcaagtacgcctgggttcttgacaagctcaaagccgagcgtgagcgtggtatcaccattgatatcgctctctggaagttcgagactcctcgctactatgtcaccgtcattggtatgttgtcactgtctcacactatcatgcttgcatcatgctaacatctctgtcagatgcccccggtcatcgtg

SEQ ID NO: 1352 - DNA, 566 bp, Geomyces pannorum
tccgtaggtgaacctgcggaaggatcattacagtagtcacccaggttgccgcaaggcctcctgggtaacctaccaccctttgtttattacactttgttgctttggcaagcctgccctcgggctgctggctccggccggcgagcgcttgccagaggacctaaactctgtttgtctatactgtctgagtactatataatagttaaaactttcaacaacggatctcttggttctggcatcgatgaagaacgcagcgaaatgcgataagtaatgtgaattgcagaattcagtgaatcatcgaatctttgaacgcacattgcgccccctggtattccggggggcatgcctgtccgagcgtcattacaaccctcaagctcagcttggtattgggccccgccgacccggcgggccctaaagtcagtggcggtgccgtccggctccgagcgtagtaattcttctcgctctggaggtccggtcgtgtgctcgccagcaacccccaatttttttcaggttgacctcggatcaggtagggatacccgctgaacttaagcatatcaataagcggagga

SEQ ID NO: 1353 - DNA, 571 bp, Gibberella avenacea
aaagtcgtaacaaggtctccgttggtgaaccagcggagggatcattaccgagtttacaactcccaaacccctgtgaacataccttaatgttgcctcggcggatcagcccgcgccccgtaaaacgggacggcccgccagaggacccaaactctaatgtttcttattgtaacttctgagtaaaacaaacaaataaatcaaaactttcaacaacggatctcttggttctggcatcgatgaagaacgcagcaaaatgcgataagtaatgtgaattgcagaattcagtgaatcatcgaatctttgaacgcacattgcgcccgctggtattccggcgggcatgcctgttcgagcgtcatttcaaccctcaagcccccgggtttggtgttggggatcggctctgccttctggcggtgccgcccccgaaatacattggcggtctcgctgcagcctccattgcgtagtagctaacacctcgcaactggaacgcggcgcggccatgccgtaaaaccccaacttctgaatgttgacctcggatcaggtaggaatacccgctgaacttaagcatatcaataag

SEQ ID NO: 1354 - DNA, 625 bp, Hypocrea sp.
tataagtcgtaacaaggtctccgttggtgaaccagcggagggatcattaccgagtttacaactcccaaacccctatgtgaacgttaccaaactgttgcctcggcgggaaattcatgccccgggcgcgtcgcagccccggaccaaggcgcccgccggaggaccaaccaaaactcttttgtatgtccctcgcggacttttataattctgaaccatctcggcgcccctagcgggcgtttcgaaaatgaatcaaaactttcaacaacggatctcttggttctggcatcgatgaagaacgcagcgaaatgcgataagtaatgtgaattgcagaattcagtgaatcatcgaatctttgaacgcacattgcgcccgccagtattctggcgggcatgcctgtccgagcgtcatttcaaccctcgaacccctccgggggtccggcgttggggatcggcccttaccggccggccccgaaatacagtggcggtctcgccgcagcctctcttgcgcagtagtttgcacactcgcatcgggagcgcggcgcgtccacgtccgtaaaacacccaacttctgaaatgttgacctcggatcaggtaggaatacccgctgaacttaagcatatcaataagcg

SEQ ID NO: 1355 - DNA, 537 bp, Macrophoma sp.
cattaccaatatgaaagcggatggggagccacagaagctagagtcctcgtggctctgtttctgccctatctgtctgaatattcacccatgtcttttgcgtaccaattgtttccttggtgggccatcccgccaacaggacattgttaaaccttttgtaattgcagtcagcgtcagaaaaacttaatagttacaactttcaacaacggatctcttggttctggcatcgatgaagaacgcagcgaaatgcgataagtagtgtgaattgcagaattcagtgaatcatcgaatctttgaacgcacattgcgccccttggtattccatggggcatgcctgttcgagcgtcatttgtaccctcaagctctgcttggtgttgggcgtttgtctcccctgggagactcgcctcaaaacaattggcagccggcatattggtatcggagcgcagcacaagtcgcgcttctgtccatgaatgttggcatccagcaagaccatttttcactcttgacctcggatcaggtagggatacccgctgaacttaa

SEQ ID NO: 1356 - DNA, 555 bp, Microdochium bolleyi
tccgtaggtgaacctgcggagggatcattactgagtttttaactctccaaaccatgtgaacttaccactgttgcctcggtggtcggtgctggaaacagtgctgccaccggtggactactaaactcttgttaatttttgtcaaatctgaatcaaactaagaaataagttaaaactttcaacaacggatctcttggttctggcatcgatgaagaacgcagcgaaatgcgataagtaatgtgaattgcagaattcagtgaatcatcgaatctttgaacgcacattgcgcccattagtattctagtgggcatgcctgttcgagcgtcatttcaacccttaagcctagcttagtgttgggagactgcctaatacgcagctcctcaaaaccagtggcggagtctgttcgtgctctgagcgtagtaattttttatctcgcttctgcaagccggccagacgacagccataaaccgcaccctctcggggggcacttttttaatggttgacctcggatcaggtaggaatacccgctgaacttaagcatatcaataagcggaggaa

SEQ ID NO: 1357 - DNA, 634 bp, Mortierella hyalina
tttccgtaggtgaacctgcggaaggatcattcataataagtgttttatggcacttttttaaatccatatccaccttgtgtgcaatgtcagggttggtttctctcttttgagagatcaaccccaaacatcaactctatcttaactctttgtctgaaaaatattatgaataaaacaattcaaaatacaactttcaacaccggatctcttggctctcgcatcgatgaagaacgcagcgaaatgcgatacgtaatgtgaattgcagaattcagtgaatcatcgaatctttgaacgcatattgcgctctttggtattccgaagagcatgcttgtttgagtatcagtaaacacctcaaagccttttttcttttttgaagaaaggctttggacttgagcaatcccaacaccaatcttttaaagagagggggggggttgcttgaaatgcaggtgcagctggacattctcctgagctaaaagcatattcatttagtcccgtcaaacggattattacttttgctgcagctaatataaagggagtttgaccattttggctgactgatgcaggattttcacaagagtcttcaaaacctcttgttaaactcgatctcaaatcaagtaagactacccgctgaacttaa

SEQ ID NO: 1358 - DNA, 557 bp, Nigrospora oryzae
tctcgttggtgaccagcggagggatcattacagagttatccaactcccaaacccatgtgaacttatctctttgttgcctcggcgcaagctacccgggacccagcgccccgggcggcccgccggcggacaaaccaaactcttgttatcttagttgattatctgagcgtcttatttaataagtcaaaactttcaacaacggatctcttggttctggcatcgatgaagaacgcagcgaaatgcgataagtaatgtgaattgcagaattcagtgaatcatcgaatctttgaacgcacattgcgcccattagtattctagtgggcatgcctgttcgagcgtcatttcaacccctaagcacagcttactgttgggactctacggcctccgtagttccctaatgcgattggcggagtggcagtagtcctctgagcgtagtaattctttatctcgcttttgttaggtgctgcccccccggccgttaaacccccaattttttctggttgacctcggatcaggtaggaatacccgctgaacttaagcatatcaataggssggaggaa

SEQ ID NO: 1359 - DNA, 528 bp, Nectria sp.
gtttacaactcccaaacccctgtgaacatacctatcgttgcttcggcggatccgccccggtgccttcgggcccggactcaggcgcccgccgggggacccaaactcttgtatttctttagtatcttctgagtaaacaagcaaataaattaaaactttcaacaacggatctcttggttctggcatcgatgaagaacgcagcgaaatgcgataagtaatgtgaattgcagaattccgtgaatcatcgaatctttgaacgcacattgcgcccgccagtattctggcgggcatgcctgttcgagcgtcatttcaaccctcaagcccccgggcttggtgttggggctcggcccgtccctagcggcgcgccgtccccgaaatctagtggcggtcacgctgtactcctctgcgtagtaatctaacctcgcaacgggacaaagcgcggccacgccgttaaacccccaacttctgaaggttgacctcggatcaggtaggaatacccgctgaacttaagcatatcaataagcggaggac

SEQ ID NO: 1360 - DNA, 638 bp, Ophiosphaerella sp.
ggctcagtgaggccttcggactggcttggggaggttggcaacgaccaccctaagccggaaagttcgtcaaactcggtcatttagaggaagtaaaagtcgtaacaaggtttccgtaggtgaacctgcggaaggatcattaaatgatagtactggccctaaggtgtggtaatacatgccggtgggcttcacgtctattacccttgtttttcgagtacctatgtttccttggtgggcttgcccaccaattggacaccctattaaacctttttaatttttaattagcgtctgaataaacttaataattacaactttcaacaacggatctcttggttctggcatcgatgaagaacgcagcgaaatgcgataagtagtgtgaattgcagaattcagtgaatcatcgaatctttgaacgcacattgcgccccttggtattccatggggcatgcctgttcgagcgtcatttgtaccctcaagctatgcttggtgttgggtgtttgtcctctccattgcgtttggactcgccttaaagcaattggcagccagtgttttggttttaagcgcagcacattttgcgtcttactcccttgaatactagcatccattaagcctttttatcacttttgacctcggatcaggta

SEQ ID NO: 1361 - DNA, 524 bp, Oidiodendron cerealis
cattacagagttcatgccctagcgggtagatctcccacccactgttattgttactgtcgttgctttggcgggccgccgggcccagctcggccgccggctccggctggcgcgcgcccgccagaggccttcaaactctgaatgttagtgtcgtctgagtactatacaatagttaaaactttcaacaacggatctcttggttctggcatcgatgaagaacgcagcgaaatgcgataagtaatgcgaattgcagaattcagtgagtcatcgaatctttgaacgcacattgcgccctgtggtattccgcagggcatgcctgttcgagcgtcatttcaaccctcaagctctgcttggtgttgggccacgcccccgcggccggccccaaagctagtggcggtgccgtctggctctaagcgtagtacatctctcgctctagggcccggcggttgcttgccagaacccacactcttatggttgacctcggatcaggtagggatacccgctgaacttaagcatatcaataagcg

SEQ ID NO: 1362 - DNA, 610 bp, Penicillium aurantiogriseum
ggaagtaaaagtcgtaacaaggtttccgtaggtgaacctgcggaaggatcattaccgagtgagggccctttgggtccaacctcccacccgtgtttattttaccttgttgcttcggcgggcccgcctttactggccgccggggggcttcacgcccccgggcccgcgcccgccgaagacaccctcgaactctgtctgaagattgaagtctgagtgaaaatataaattatttaaaactttcaacaacggatctcttggttccggcatcgatgaagaacgcagcgaaatgcgatacgtaatgtgaattgcaaattcagtgaatcatcgagtctttgaacgcacattgcgccccctggtattccggggggcatgcctgtccgagcgtcattgctgccctcaagcccggcttgtgtgttgggccccgtcctccgattccgggggacgggcccgaaaggcagcggcggcaccgcgtccggtcctcgagcgtatggggctttgtcacccgctccgtaggcccggccggcgcttgccgatcaacccaaatttttatccaggttgacctcggatcaggtagggatacccgctgaacttaagcatatcaataagcggagga

SEQ ID NO: 1363 - DNA, 585 bp, Penicillium commune
cgtaggtgaacctgcggaaggatcattaccgagtgagggccctctgggtccaacctcccacccgtgtttattttaccttgttgcttcggcgggcccgccttaactggccgccggggggctcacgcccccgggcccgcgcccgccgaagacaccctcgaactctgtctgaagattgaagtctgagtgaaaatataaattatttaaaactttcaacaacggatctcttggttccggcatcgatgaagaacgcagcgaaatgcgatacgtaatgtgaattgcaaattcagtgaatcatcgagtctttgaacgcacattgcgccccctggtattccggggggcatgcctgtccgagcgtcattgctgccctcaagcccggcttgtgtgttgggccccgtcctccgatttccgggggacgggcccgaaaggcagcggcggcaccgcgtccggtcctcgagcgtatggggctttgtcacccgctctgtaggcccggccggcgcttgccgatcaacccaaatttttatccaggttgacctcggatcaggtagggatacccgctgaacttaagcatatcaataagcggaggaa

SEQ ID NO: 1364 - DNA, 1384 bp, Penicillium griseofulvum
cagcgagtacatcaccttaaccgagaggtttgggtaatcttgttaaaccctgtcgtgctggggatagagcattgcaattattgctcttcaacgaggaatgcctagtaggcacgagtcatcagctcgtgccgattacgtccctgccctttgtacacaccgcccgtcgctactaccgattgaatggctcagtgaggccttgggattggcttaggagggttggcaacgaccccccagagccgaaaacttggtcaaactcggtcatttagaggaagtaaaagtcgtaacaaggtttccgtaggtgaacctgcggaaggatcattactgagtgagggccctctgggtccaacctcccacccgtgtttatttaccttgttgcttcggcgggcccgccttaactggccgccggggggcttacgcccccgggcccgcgcccgccgaagacaccctcgaactctgtctgaagattgtagtctgagtgaaaatataaattatttaaaactttcaacaacggatctcttggttccggcatcgatgaagaacgcagcgaaatgcgatacgtaatgtgaattgcaaattcagtgaatcatcgagtctttgaacgcacattgcgccccctggtattccggggggcatgcctgtccgagcgtcattgctgccctcaagcacggcttgtgtgttgggccccgtcctccgattccgggggacgggcccgaaaggcagcggcggcaccgcgtccggtcctcgagcgtatggggctttgtcacccgctctgtaggcccggccggcgcttgccgatcaacccaaatttttatccaggttgacctcggatcaggtagggatacccgctgaacttaagcatatcaataagcggaggaaaagaaaccaacagggattgccccagtaacggcgagtgaagcggcaagagctcaaatttgaaagctggctccttcggggtccgcattgtaatttgtagaggatgcttcgggagcggtccccatctaagtgccctggaacgggacgtcatagagggtgagaatcccgtatgggatggggtgtccgcgcccgtgtgaagctccttcgacgagtcgagttgtttgggaatgcagctctaaatgggtggtaaatttcatctaaagctaaatattggccggagaccgatagcgcacaagtagagtgatcgaaagatgaaaagcactttgaaaagagagttaaaaagcacgtgaaattgttgaaagggaagcgcttgcgaccagactcgctcgcggggttcagccggcattcgtgccggtgtacttccccgcgggcgggccagcgtcggtttgggcggtcggtcaaaggccctcggaaggtaacgcccctaggggcgtcttatagccgagggtgc

SEQ ID NO: 1365 - DNA, 610 bp, Penicillium solitum
tccgtaggtgaacctgcggaaggatcattaccgagtgagggccctctgggtccaacctcccacccgtgtttattttaccttgttgcttcggcgggcccgccttaactggccgccggggggctcacgcccccgggcccgcgcccgccgaagacaccctcgaactctgtctgaagattgaagtctgagtgaaaatataaattatttaaaactttcaacaacggatctcttggttccggcatcgatgaagaacgcagcgaaatgcgatacgtaatgtgaattgcaaattcagtgaatcatcgagtctttgaacgcacattgcgccccctggtattccggggggcatgcctgtccgagcgtcattgctgccctcaagcccggcttgtgtgttgggccccgtcctccgatttccgggggacgggcccgaaaggcagcggcggcaccgcgtccggtcctcgagcgtatggggctttgtcacccgctctgtaggcccggccggcgcttgccgatcaacccaaatttttatccaggttgacctcggatcaggtagggatacccgctgaacttaagcatatcaataagcggaggaaaagaaaccaacagggattgcccc

SEQ ID NO: 1366 - DNA, 609 bp, Penicillium tricolor
tccgtaggtgaacctgcggaaggatcattaccgagtgagggccctttgggtccaacctcccacccgtgtttattttaccttgttgcttcggcgggcccgcctttactggccgccggggggctcacgcccccgggcccgcgcccgccgaagacacctccgaactctgtctgaagattgaagtctgagtgaaaatataaattatttaaaactttcaacaacggatctcttggttccggcatcgatgaagaacgcagcgaaatgcgatacgtaatgtgaattgcaaattcagtgaatcatcgagtctttgaacgcacattgcgccccctggtattccggggggcatgcctgtccgagcgtcattgctgccctcaagcccggcttgtgtgttgggccccgtcctccgattccgggggacgggcccgaaaggcagcggcggcaccgcgtccggtcctcgagcgtatggggctttgtcacccgctctgtaggcccggccggcgcttgccgatcaacccaaatttttatccaggttgacctcggatcaggtagggatacccgctgaacttaagcatatcaataagcggaggaaaagaaaccaacagggattgcccc

SEQ ID NO: 1367 - DNA, 634 bp, Periconia macrospinosa
atggctcagtgaggccttcggactggctcgaggaggttggcaacgaccaccccgagccggaaagttggtcaaactcggtcatttagaggaagtaaaagtcgtaacaaggtttccgtaggtgaacctgcggaaggatcattacacattcggggcgcttcggcgctccttatacacccaccctctgcctacgtgtacctctatagcttcctcggcgggctcgcccgccgccaggaacccacgaaaccccttgcattatacgcgaaaacttctgataacaaacctaaattatcacaactttcaacaatggatctcttggttctggcatcgatgaagaacgcagcgaaatgcgataagtagtgtgaattgcagaattcagtgaatcatcgaatctttgaacgcacattgcggccataggtattcctttggccatgcctgttcgagcgtcatttacaccctcaagcctagcttggtgttgggcgtctgtcccgccgttctcgcgcgcggactcgcctcaaagtcattggcggcggtcgtgccggccccctcgcgcagcacatttgcgcttctcggaggcccggcggatccgcgctccagcaagacctttcacgacttgacctcggatacaggtagggat

SEQ ID NO: 1368 - DNA, 585 bp, Phaeosphaeria avenaria
tccgtaggtgaacctgcggaaggatcattacactcagtagtttactactgtaaaggaggctgttagtctgtatagcgcaagctgatgagcagctagcctcttttatccacccttgtcttttgcgtacccacgtttcctcggcaggcttgcctgccgattggacaaacctataacctttttaattttcaatcagcgtctgaaaaacttaataattacaactttcaacaacggatctcttggttctggcatcgatgaagaacgcagcgaaatgcgataagtagtgtgaattgcagaattcagtgaatcatcgaatctttgaacgcacattgcgccccttggtattccatggggcatgcctgttcgagcgtcatttgtaccctcaagctctgcttggtgttgggtgtttgtcctctccctagtgtttggactcgccttaaaataattggcagccagtgttttggtattgaagcgcagcacaagtcgcgattcttatcaaatacttgcgtccacaagcccttttttaacttttgacctcggatcaggtagggatacccgctgaacttaagcatatcaataagcggagga

SEQ ID NO: 1369 - DNA, 523 bp, Preussia africana
  modified_base (3)..(3): a, c, t or g
aangaagtaaaagtcgtaacaaggtttccgtaggtgaacctgcggaaggatcattatcgtagggcttcggccctgtcgagatagaacccttgcctttttgagtacctttcgtttcctcggcaggctcgcctgccaatggggaccacaaaaaacactttgcagtacctgtaatagtctgaacaaacaaacaaaaattaaaactttcaacaacggatctcttggttctggcatcgatgaagaacgcagcgaaatgcgataagtagtgtgaattgcagaattcagtgaatcatcgaatctttgaacgcacattgcgccctttggtattccttagggcatgcctgttcgagcgtcatttaaaccttcaagctcagcttggtgttgggtgactgtccgcttcactgcggactcgcctcaaaattattggcggccggtacattggcttcgagcgcagcagaaacgcgaactcgggcccgtcgtattggctcccagaagctatcttcacaatttgacctcggatcaggta

SEQ ID NO: 1370 - DNA, 528 bp, Preussia minima
gaacctgcggaaggatcattatcgttgggcttcggcccattcgagataatacccttgcctttttgagtaccttttcgtttcctcggcaggctcgcctgccaacggggacccttcaaaacgccttgtaatacctgtaattgtctgatataacaagcaaaaattaaaactttcaacaacggatctcttggttctggcatcgatgaagaacgcagcgaaatgcgataagtagtgtgaattgcagaattcagtgaatcatcgaatctttgaacgcacattgcgccctttggtattccttagggcatgcctgttcgagcgtcatttaaaccttcaagctcagcttggtgatgggtgactgtcccccccttcgcggggggactcgcctcaaaaacattggcggccggtacattggcttcgagcgcagcagaaacgcggtctcgagcccggtggatcgtctcccataagctccttctttattttgacctcggatcaggtagggatacccgctgaacttaagcatatcaataagcg

SEQ ID NO: 1371 - DNA, 350 bp, Pyrenomataceae sp.
gcatcgatgaagaacgcagcgaaatgcgataagtagtgtgaattgcagaattcagtgaatcatcgaatctttgaacgcacattgcgcctcctggtattccgggaggcatgcctgttcgagcgtcattaaaatcactcaagcttaggtttacctattgcttggtcttggagatggaagccaattcattggaatcctcttcgaaattcaatggcgaagacccttgctctcccaagtgtagtaataacttatgtcactgaaggaagcgagaaatcttctgccgtaacccccatattttctatgattgacctcggatcaggtagggatacccgctgaacttaagcatatcaata

SEQ ID NO: 1372 - DNA, 545 bp, Pyrenophora teres
ggatcattacacaaatatgaaggcagattgggtagtccccgcttttgggggtttgcccattctggcgccatattcacccatgtcttttgcgtactacttgtttccttggcgggctcgcccgccaattggactttattcaaacctttttttattgcaatcagcgtcagcaaaacaatgtaatcaattacaactttcaacaacggatctcttggttctggcatcgatgaagaacgcagcgaaatgcgataagtagtgtgaattgcagaattcagtgaatcatcgaatctttgaacgcacattgcgccctttggtattccaaagggcatgcctgttcgagcgtcatttgtaccctcaagctttgcttggtgttgggcgtcttttgtctctcccccgagactcgccttaaaaacattggcagccggcctactggtttcggagcgcagcacattatttgcgctcttgtccagccgcggtcgcgcgtccatgaagccttttttttttaaccttttgacctcggatcaggtagggatacccgctgaacttaa

SEQ ID NO: 1373 - DNA, 547 bp, Pyrenophora triticirepentis
ccgtaggtgaacctgcggagggatcattacacaaatatgaagccggactgggatagggcctcgctgccttgcccgtctggcgccatattcacccatgtctttttgcgtactacttgtttccttggcgggtccgcccgccaattggaccttattcaaaccttttttttcagttgcaatcagcgtcagcaaaacaaatgtaatcaattacaactttcaacaacggatctcttggttctggcatcgatgaagaacgcagcgaaatgcgataagtagtgtgaattgcagaattcagtgaatcatcgaatctttgaacgcacattgcgccctttggtattccaaagggcatgcctgttcgagcgtcatttgtaccctcaagctttgcttggtgttgggcgtcttgtctctctcccgagactcgccttaaaatcattggcagccggcctactggtttcggagcgcagcacattatttgcgctcttgtccagccgcggtcgcgcgtccatgaagcttctttcaaccttttgacctcggatcaggtagggatacc

SEQ ID NO: 1374 - DNA, 563 bp, Pyronema domesticum
taacaaggtttccgtaggtgaacctgcggaaggatcattaaaagttaattggttatactccggtataaatctaattaaacacctctgagtaccttacctgttgcttccgtgaggcctgactccagtagtggttcgccaccactggatacttgcggaaggtatacacttaaacactttgaatctatgtcatctgtctgataatgtttataacaaacgttaaaactttcaacaacggatctcttggttctcgcatcgatgaagaacgcagcgaaatgcgataagtagtgtgaattgcagaattcagtgaatcatcgaatctttgaacgcacattgcgcctcctggtattccgggaggcatgcctgttcgagcgtcattaaaacctcctcaagctcttttgcttggtattggaagaagaggccgcttgtcggtctccctttcgaaatgcaatggcagattgcctcatgtgccctggcgtaataagatttatctttcgcttgtgcattgggatgatcccgccgcaaacccccaattttttctggttgacctcggatcaggtagggat

SEQ ID NO: 1375 - DNA, 537 bp, Thielavia hyalocarpa
gagggatcattacagagttgcaaaactccctaaaccattgtgaacgttaccttcaaaccgttgcttcggcgggcggcaccgggcccgcccggtgccccctggccccccccagcggggcgcccgccggaggaaacccaactcttgatacattatggcctctctgagtcttctgtactgaataagtcaaaactttcaacaacggatctcttggttctggcatcgatgaagaacgcagcgaaatgcgataagtaatgtgaattgcagaattcagtgaatcatcgaatctttgaacgcacattgcgcccgccagtattctggcgggcatgcctgttcgagcgtcatttcaaccatcaagcccccgggcttgtgctggggacctgcggctgccgcaggccctgaaaaccagtggcgggctcgctgtcacaccgggcgtagtagattttatctcgctcagggcgtgctgcgggctccggccgttaaaaagcctttttcacccaaggttgacctcggatcaggtaggaagacccgctgaactta

SEQ ID NO: 1376 - DNA, 635 bp, Trichoderma harzianum
tagaagtcgtaacaaggtctccgttggtgaaccagcggagggatcattaccgagtttacaactcccaaacccaatgtgaacgttaccaaactgttgcctcggcgggatctctgccccgggtgcgtcgcagccccggaccaaggcgcccgccggaggaccaacctaaaactcttattgtataccccctcgcgggtttttttataatctgagcctttctcggcgcctctcgtaggcgtttcgaaaatgaatcaaaactttcaacaacggatctcttggttctggcatcgatgaagaacgcagcgaaatgcgataagtaatgtgaattgcagaattcagtgaatcatcgaatctttgaacgcacattgcgcccgccagtattctggcgggcatgcctgtccgagcgtcatttcaaccctcgaacccctccggggggtcggcgttggggatcggccctcccttagcgggtggccgtctccgaaatacagtggcggtctcgccgcagcctctcctgcgcagtagtttgcacactcgcatcgggagcgcggcgcgtccacagccgttaaacacccaacttctgaaatgttgacctcggatcaggtaggaatacccgctgaacttaagcatatcaataagcg

SEQ ID NO: 1377 - DNA, 225 bp, Acremonium alternatum
gggtacataaactcccaaaccattgtgaacttaccactgttgcttcggcggcctcgccccgggcgcgttcgcgcggcccggacccaggcgtccgccggaggctccaaactcttgtcttttagtgtatttctgagtggcataagcaaataaatcaaaactttcagcaacggatctcttggttctggcatcgatgaagaacgcagcaggactaacgtgtgtcgacgg

SEQ ID NO: 1378 - DNA, 225 bp, Alternaria alternata
gccaatgaacacctgcggagggatcattacacaaatatgaaggcgggctggacctctcggggttacagccttgctgaataatcccccttgtcttttgcgtacttcttgtttccttggtgggttcgcccaccactaggacaaacataaaccttttgtaattgcaatcagcgtcagtaacaaattaataattacaactttcaacaacggatctcttggttctggcat

SEQ ID NO: 1379 - DNA, 240 bp, Alternaria brassicae
gactttcatagtaggaggagcgggctggaatcaccctctcggggggtacagccttgctgaattatttcacccttgtcttttgcgtacttcttgtttccttggtgggttcgcccaccactaggacaaacataaaccttttgtaattgcaatcagcgtcagtaacaaattaataattacaactttcaacaacggatctcttggttctggcatcgatgaagaacgcacagtcagtgtgaaatc

SEQ ID NO: 1380 - DNA, 224 bp, Alternaria compacta
tgcgtatgtccgacatatcaggcgggctggacctctcggggttacagccttgctgaattattcaccccttgtcttttgcgtacttcttgtttccttggtgggttcgcccaccactaggacaaacataaaccttttgtaattgcaatcagcgtcagtaacaaattaataattacaactttcaacaacggatctcttggttctggcatcgatgaaaaacgcatcaa

SEQ ID NO: 1381 - DNA, 297 bp, Alternaria dianthi
cctccggactggctcgaggaggttggcaacgaccacctcaagccggaaagttggtcaaactcggtcatttagaggaagtaaaagtcgtaacaatttctccgtaggtgaacctgcggagggatcattacacaggtatgaaggcgggctggaatctctcggggttacagccttgctgaattattcacccgtgtcttttgcgtacttcttgtttcctgggtgggttcgcccaccaccaggaccaaccataaaccttttgtaattgcaatcagcgtcagtaacaaaataataattacaact

SEQ ID NO: 1382 - DNA, 249 bp, Alternaria longipes
tggtaattacaaaatgaagcgggctggacctctcggggttacagcctgctgaattattcacccttgtcttttgcgtacttcttgtttccttggtgggttcgcccaccactaggacaaacataaaccttttgtaattgcaatcagcgtcagtaacaaattaataattacaactttcaacaacggatctcttggttctggcatcgatgaagaacgcagcaaattaatgccggctggaacgcctctgggata

SEQ ID NO: 1383 - DNA, 227 bp, Alternaria mali
atcgtggaggtcaggactattacacatatgaaggcgggctggaacctctcggggttacagccttgctgaattattcacccttgtcttttgcgtacttcttgtttccttggtgggttcgcccaccactaggacaaacataaaccttttgtaattgcaatcagcgtcagtaacaaattaataattacaactttccacaacgggatctcttgggttctggcatcgctagc

SEQ ID NO: 1384 - DNA, 210 bp, Alternaria sesami
aggcgggctggcacctctcggggtggccagccttgctgaattattccacccgtgtcttttgcgtacttcttgtttccttggtgggctcgcccaccacaaggaccaacccataaacctttttgtaatggcaatcagcgtcagtaacaatgtaataattacaactttcaacaacggatctcttggttctggcatcgatgaagaacgcagcaa

SEQ ID NO: 1385 - DNA, 256 bp, Alternaria solani
atgtgtcatggtatgaggcgggctggacctctcggggttacagccttgctgaattattcacccttgtcttttgcgtacttcttgtttccttggtgggttcgcccaccactaggacaaacataaaccttttgtaattgcaatcagcgtcagtaacaaattaataattacaactttcaacaacggatctcttggttctggcatcgatgaagaacgcagcgaaatgcgataagtagtgtgaattgcagaattcagtaat

SEQ ID NO: 1386 - DNA, 263 bp, Alternaria sp.
aggcgggctggacctctcggggttacagccttgctgaattattcacccttgtcttttgcgtacttcttgtttccttggtgggttcgcccaccactaggacaaacataaaccttttgtaattgcaatcagcgtcagtaacaaattaataattacaactttcaacaacggatctcttggttctggcatcgatgaagaacgcagctaaatacatatgaaggcgggctggaacgtcccgcggttgcagacttgctgacttattcacc

SEQ ID NO: 1387 - DNA, 204 bp, Alternaria tenuissima
tgaggcgggctggacctctcggggttacagccttgctgaattattcacccttgtcttttgcgtacttcttgtttccttggtgggttcgcccaccactaggacaaacataaaccttttgtaattgcaatcagcgtcagtaacaaattaataattacaactttcaacaacggatctcttggttctggcatcgatgaagaacgcagc

SEQ ID NO: 1388 - DNA, 293 bp, Ascomycota sp.
cccctaaggtcggggagtccccgcccatgagcgctttaacgggtgtgctgcggccactggagtgttggccgtctcgccgggtctcggaaagcacggggagaatccgcgtgcttacgtggggtgtgtcgaatacggacccgggatggcgtgccggcaagtgcccttcgggaggcacaagctcctgtgaagatgggcattcgccctttacgcagcacatgactgaatccttattctactcgtacctcttgttctccttcggtggggcaacctgccgttggaacctttatacaacc

SEQ ID NO: 1389 - DNA, 244 bp, Bipolaris spicifera
acgaaggccgttcgcggctggactatttattacccttgtcttttgcgcacttgttgtttcctgggcgggttcgctcgccaccaggaccacaatataaaccttttttatgcagttgcaatcagcgtcagtataacaaatgtaaatcatttacaactttcaacaacggatctcttggttctggcatcgatgaagaacgcagcaatacacactcaataaaaaacgaaggccgttcgcggacggacta

SEQ ID NO: 1390 - DNA, 246 bp, Cercospora canescens
cttcggtgcgcttcccctttgggggactttgggagggatcattactgagtgagggccttcgggctcgacctccaaccctttgtgaacacaacttgttgcttcgggggcgaccctgccgtttcgacggcgagcgcccccggaggccttcaaacactgcatctttgcgtcggagtttaagtaaattaaacaaaactttcaacaacggatctcttggttctggcatcgatgaagaacgcagcgaaatgc

SEQ ID NO: 1391 - DNA, 280 bp, Cercospora capsici
gactagctacataggcttcgggctcgacctccaccctttgtgaacacaacttgttgcttcgggggcgaccctgccgtttcgacggcgagcgcccccggaggccttcaaacactgcatctttgcgtcggagtttaagtaaattaaacaaaactttcaacaacggatctcttggttctggcatcgatgaagaacgcagcagaaatgcgataagtaatgtgaattgcagaattcagtgaatcatcgaatctttgaacgcacattgcgccccttggtattccga

SEQ ID NO: 1392 - DNA, 220 bp, Cercospora kikuchii
cgtagggtgaacctgcggagggatcattactgagtgagggccttcgggctcgacctccaaccctttgtgaacacaacttgttgcttcgggggcgaccctgccgtttcgacggcgagcgcccccggaggccttcaaacactgcatctttgcgtcggagtttaagtaaattaaacaaaactttcaacaacggatctcttggttctggcatcgatgaagaacg

SEQ ID NO: 1393 - DNA, 243 bp, Cercospora zinnia
tcgattgaatggctcagtgaggccttcggactggcccagggaggtcggcaacgaccacccagggccggaaagttggtcaaactcggtcatttagaggaagtaaaagtcgtaacaaggtctccgtaggtgaacctgcggagggatcattactgagtgagggccttcgggctcgacctccaaccctttgtgaacacaacttgttgcttcgggggcgaccctgccgtttcgacggcgatcacttgt

SEQ ID NO: 1394 - DNA, 291 bp, Chaetomium globosum
aaactccctaaccattgtgaacgttacctataccgttgcttcggcgggcggccccggggtttaccccccgggcgcccctgggccccaccgcgggcgcccgccggaggtcaccaaactcttgataatttatggcctctctgagtcttctgtactgaataagtcaaaactttcaacaacggatctcttggttctggcatcgatgaagaacgcagccatcattagagagttgcaaactccctaaacccttgtgaacgtaacctataccgttgcgttcggcgggcggcccccggg

SEQ ID NO: 1395 - DNA, 263 bp, Chaetomium piluliferum
cattacagagttgcaaaactccctaaaccattgtgaacgttaccttcaaaccgttgcttcggcgggcggccccgctccgcccggtgccccctggccccctagcggggcgcccgccggaggaaaacccaactcttgattataatggcctctctgtctcttctgtactgaataagtcaaaactttcaacaacggatctcttggttctggcatcgatgaagaacgcagcgaaatgcgataagtaatgtgaattgcagaattcagtg

SEQ ID NO: 1396 - DNA, 210 bp, Chaetomium sp.
ctccctaaccattgtgaacgttacctaaaccgttgcttcggcgggcggccccggggtttaccccccgggcgcccctgggccccaccgcgggcgcccgccggaggtcaccaaactcttgataatttatggcctctctgagtcttctgtactgaataagtcaaaactttcaacaacggatctcttggttctggcatcgatgaaaaacgcagc

SEQ ID NO: 1397 - DNA, 255 bp, Cladosporium cladosporioides
tctaccaccgggatgttcataaccctttgttgtccgactctgttgcctccggggcgaccctgccttcgggcgggggctccgggtggacacttcaaactcttgcgtaactttgcagtctgagtaaatttaattaataaattaaaacttttaacaacggatctcttggttctggcatcgatgaagaacgcagccaaaccagcaaacccggtctaacccccgggatgttcatgaccctttgttgtccgactctgaggc

SEQ ID NO: 1398 - DNA, 240 bp, Cladosporium sp.
actgcttcattacaacaacgcccgggcttcggcctggttattcaaaaccctttgttgtccgactctgttgcctccgcggcgaccctgccttcgggcgggggctccgggtggacacttcaaactcttgcgtaactttgcagtctgagtaaacttaattaataaattaaaacttttaacaacggatctcttggttctggcatcgatgaagaacggagcgaaatgcgataagtaatgaattgc

SEQ ID NO: 1399 - DNA, 226 bp, Cladosporium uredinicola
ggtctaccaccgggatgttcataaccctttgttgtccgactctgttgcctccggggcgaccctgccttcgggcgggggctccgggtggacacttcaaactcttgcgtaactttgcagtctgagtaaacttaattaataaattaaaacttttaacaacggatctcttggttctggcatcgatgaagaacgcagcgaaaatcaagtgggtctgcccccgcgatgggat

SEQ ID NO: 1400 - DNA, 250 bp, Cochliobolus sp
gctaattaaccaataacctatgaaggctgtacgccgctgcgcccccggccagttggctgaggctggattatttattaccccttgtcttttgcgcacttgttgtttcctgggcgggttcgcccgcctccaggaccacaccataaaccttttttatgcagttgcaatcagcgtcagtacaacaaatgtaaatcatttacaactttcaacaacggatctcttggttctggcatcgatgaagaaccgcaacagc

SEQ ID NO: 1401 - DNA, 249 bp, Phanerochaete crassa
ggttgtagctggcctcatactgggcatgtgcacacctggctcatccactccttaacctctgtgcactttttgtaggctctggttgaaaggcgttgcttcacttcggtgtggtaatcgctggaagacctggtctatgttttattacaaacgcttcagttatacaatgtttatctgcgtataacgcatttatatacaactttcagcaacggatctcttggctctcgcatcgatgaagaacgcagctcgagt

SEQ ID NO: 1402 - DNA, 267 bp, Phoma americana
cgtacgctacatggaagtaaaagtagtaacaaggtttccgtaggtgaacctgcggaaggatcattacctagagttgtaggctttgcctgctatctcttacccatgtcttttgagtaccttcgtttcctcggcgggtccgcccgccgattggacaatttaaaccatttgcagttgcaatcagcgtctgaaaaaacttaatagttacaactttcaacaacggatctcttggttctggcatcaatgaaaaacgcagcaacacaaaattac

SEQ ID NO: 1403 - DNA, 205 bp, Phoma subherbarum
tacgtgcagcgctttgcctgctatctcttacccatgtcttttgagtaccttcgtttcctcggcgggtccgcccgccgattggacaatttaaaccatttgcagttgcaatcagcgtctgaaaaaaacttaatagttacaactttcaacaacggatctcttggttctggcatcgatgaagaacgcagcttacctagagaatgcgtgt

SEQ ID NO: 1404 - DNA, 264 bp, Phomopsis liquidambari
aggcgcacccagaaaccctttgtgaacttataccttactgttgcctcggcgcatgctggccccctcggggtcccctggagacagggagcaggcacgccggcggccaagttaactcttgtttttacactgaaactctgagaaaaaaacacaaatgaatcaaaactttcaacaacggatctcttggttctggcatcgatgaagaacgcacaagtggagggccccaggcgcccccccaaaaccttttttgagttattacttactgtt

SEQ ID NO: 1405 - DNA, 222 bp, Phomopsis sp.
ccggcgcacccagaaaccctttgtgaacttatacctactgttgcctcggcgcaggccggccttttgtcaaaaaaggccccctggagacagggagcagcccgccggcggccaaccaaactcttgtttctacagtgaatctctgaggaaaaaacataaatgaatcaaaactttcaacaacggatctcttggttctggcatcgatgaagaacgcagcatgctggc

SEQ ID NO: 1406 - DNA, 255 bp, Pleospora sp.
cgggttgggacctcacctcggtgagggctccagcttgtctgaattattcacccatgtcttttgcgcacttcttgtttcctgggcgggttcgcccgccaccaggaccaaaccataaacctttttgtaattgcaatcagcgtcagtaaacaatgtaattattacaactttcaacaacggatctcttggttctggcatcgatgaagaacgcagcgaaatgcgatacgtagtgtgaattgcagaattcagtgattttgc

SEQ ID NO: 1407 - DNA, 349 bp, Pleosporaceae sp.
ggatcattacacaatatgaaggcgggctggaacctctcggggttacagccttgctgaattattcacccttgtcttttgcgtacttcttgtttccttggtgggttcgcccaccactaggacaaacataaaccttttgtaattgcaatcagcgtcagtaacaaattaataattaccactttcaacaacgggatctcttggttctgggcatcgagcagaaaaacgcagaattgaaggcgggctgggaacctcttcgggggggtccagggctttggtgaattattcaccccttgcctttgcgtacgttgtttgttttccttggggggggtaggcacacaaaaaaagaaaacgg

SEQ ID NO: 1408 - DNA, 228 bp, Polyporales sp.
ctgaggcatgtgcacgccctactcatccactctcaacctctgtgcacttactgtaggtcggtgaaaggttcgctctgcgagctggaagccttcctatgtttcactacaaacgcttcagttttagaatgaaccttgcgtaaacgatctattacactttcacaacggactcttggccttggtgagaacgcagagcactttgtggggtcgtggtctcccgggggcctcccc

SEQ ID NO: 1409 - DNA, 222 bp, Preussia africana
aagtaccattatcgtagggcttcggccctgtcgagatagaacccttgcctttttgagtaccttttcgtttcctcggcaggctcgcctgccaatggggaccccaacaaacactttgcagtacctgtaaacagtctgaacaaacttttaaaaattaaaactttcaacaacggatctcttggttctggcatcgatgaagaacgcagcgaaatgcgataaaacgtg

SEQ ID NO: 1410 - DNA, 218 bp, Preussia sp.
ttcgagatacacccttgcctttttgagtaccttttcgtttcctcggcaggctcgcctgccaacggggacccttcaaaacgctttgtaatacctgtaactgtctgatataacaagcaaaaatcaaaactttcaacaacggatctcttggttctggcatcgatgaagaacgcagcaatcgttgggcttcggcccattagagataacacccttgccttttt

SEQ ID NO: 1411 - DNA, 254 bp, Pseudozyma sp.
acatctcgcggttcagccttgttgagtattcacccttgttttttgcggagaaatgtttgggtggagggagcaccagcaccaagacaaatctaaaccttttgcaattgcaatacgggcgacatttaccttaataattgttgatttcataagattatatcttggttgaaactccactggtaatgccatcgtctaaaatctaaaaacaacttttggcaacggatctcttggttctcgcatcgatgaagaacgcagcc

SEQ ID NO: 1412 - DNA, 277 bp, Pyrenophora teres
aggcagattgggtagtccccgcttttggggtttgcccattctggcgccatattcacccatgtcttttgcgtactacttgtttccttggcgggttcgcccgccaattggactttattcaacccttttttttttattgcaatcagcgtcagcaaaacaatgtaatcaatttacaactttcaacaacggatctcttggttctggcatcgatgaaaaacgcagccacaatatgatggccgatggggcaggcctcttttggggttgccccctctggcgccct

SEQ ID NO: 1413 - DNA, 289 bp, Colletotrichum capsici
gctcatcaccctttgtgacataccttaactgttgcttcggcgggtaggcgtcccctgaaaaggacgtctcccggccctctcccgtccgcgggtggggcgcccgccggaggataaccaaactctgatttaacgacgtttcttctgagtgacacaagcaaataatcaaaacttttaacaacggatctcttggttctggcatcgatgaagaacgcagcaattattggggtgttgctcatcatcctttgtggtgaaccttaactgttgctgcggcggggggcggcgtcccctg

SEQ ID NO: 1414 - DNA, 216 bp, Coniolariella gamsii
tgacactcccaaaacccctgtgaacataccgtacgttgcctcggcgggggggcgctccccccccgccggcggcccacgaaactctgttttgccctgaatctctgaaacgacaaactaaatcagttaaaactttcaacaacggatctcttggttctggcatcgatgaagaacgcagcgaaatatagaagtgacccaactcctaaccactgtgaacaa

SEQ ID NO: 1415 - DNA, 268 bp, Coniothyrium aleuritis
tagacttcactaaagcttgtagacttcggtctgctacctcttacccatgtcttttgagtaccttcgtttcctcggcgggtccgcccgccgattggacaacattcaaaccctttgcagttgcaatcagcgtctgaaaaaacataatagttacaactttcaacaacggatctcttggttctggcatcgatgaagaacgcagcgaaatgcgataagtagtgtgaattgcagaattcagtgaatcatcgaatctttgaacgcacattgcgcc

SEQ ID NO: 1416 - DNA, 210 bp, Coniothyrium sp.
gggctggatctctcggggttacagccttgctgaattattcacccttgtcttttgcgtacttcttgtttccttggtgggttcgcccaccactaggacaaacataaaccttttgtaattgcaatcagcgtcagtaacaaattaataattacaactttcaacaacggatctcttggttctggcatcgatgaagaacgcagcaacactaatatg

SEQ ID NO: 1417 - DNA, 218 bp, Corynespora cassiicola
cgccccttcgagatagcaccctttgtttatgagcacctctcgtttcctcggcaggctcgcctgccaacggggacccaccacaaacccattgtagtacaagaagtacacgtctgaacaaaacaaaacaaactatttacaactttcaacaacggatctcttggttctggcatcgatgaagaacgcagcggatatcgtaggggccgcgcccccttccagat

SEQ ID NO: 1418 - DNA, 204 bp, Diaporthe sp.
accctttgtgaacttatacctaccgttgcctcggcgcaggccggcccccctcaccgggggccccccggagacggggagcagcccgccggcggccaaccaaactcttgtttcttagtgaatctctgagtaaaaatcataaatgaatcaaaactttcaacaacggatctcttggttctggcatcgatgaagaacgcagcaagttgc

SEQ ID NO: 1419 - DNA, 281 bp, Diatrype sp.
ccatgtgaacttacctttgttgcctcggcgggagagcctacccggtacctaccctgtagttacccgggagcgagctaccctgtagcccgctgctggccgacccgccggtggacagtaaaactcttgttttttagtgattatctgagtgtttatacttaataagttaaaactttcaacaacggatctcttggttctggcatcgatgaagaacgcagccaatacagagttatcttctcccagcccatgtgaacttacctttgttgccccggcgggagagccta

SEQ ID NO: 1420 - DNA, 338 bp, Drechslerella dactyloides
ggttagaaactgttgtttcggcgggatctctgccccgggggcgtcgcagccccggaccaagggggccgccggaggaccaaccaaaactctttttgtataccccctcgcgggttttttttataatctgagccttctcggcgcctctcgtaggcgtttcgaaaatgaatcaaaacttttaaaaacggatctcttggttctggcatcggatgaagaacgcagagaaatgcgataagtaatgtgaattgcagaattcactgaatcatctaatctttgaacggacattgcgcccgccagttttctggcgggcatgcctgtccgagcgtcatttcaaccctcga

SEQ ID NO: 1421 - DNA, 247 bp, Embellisia indefessa
tgctttttttgaacgcacattgcgccctttggtattccaaagggcatgcctgttcgagcgtcatttgtaccctcaagctttgcttggtgttgggcgtcttgtctccagttcgctggagactcgccttaaagtcattgcagccggcctactggtttcggagcgcagcacaagtcgcgctctcttccagccaaggtcagcatccacaaagccttttttcaacttttgacctcggatcaggtatcgatgc

SEQ ID NO: 1422 - DNA, 207 bp, Epicoccum nigrum
ttgtagacttcggtctgctacctcttacccatgtcttttgagtaccttcgtttcctcggcgggtccgcccgccgattggacaacattcaaaccctttgcagttgcaatcagcgtctgaaaaaacataatagttacaactttcaacaacggatctcttggttctggcatcgatgaaaaacgcatcacctagagtttgtagacttcggt

SEQ ID NO: 1423 - DNA, 234 bp, Epicoccum sp.
gtacttacctacgatttgtggagttcggtctgctacctcttacccatgtctttttaagtaccttcgtttcctcggcgggtccgcccgccggttggacaacattcaaaccctttgcagttgcaatcagcgtctgaaaaaacttaatagttacaactttcaacaacggatctcttggttctggcatcgaacacaaacgcagcagcttttagggacctaccgtctcctcctcttacc

SEQ ID NO: 1424 - DNA, 237 bp, Exserohilum rostratum
gctaatttccccaccaaacttgtagggtgtggtttgctggcaacagcgaaccgccccaagtatttttcacccatgtcttttgcgcactttttgtttcctgggccagttcgctcgccaccaggacccaaccataaacctttttttatgcagttgcaatcagcgtcagtataataattcaatttattaaaactttcaacaacggatctcttggttctggcatcgatgaagaacgcacaa

SEQ ID NO: 1425 - DNA, 223 bp, Fusarium chlamydosporum
tcccaacccctgtgacatacctatacgttgcctcggcggatcagcccgcgccccgtaaaacgggacggcccgcccgaggacccctaaactctgtttttagtggaacttctgagtaaaacaaacaaataaatcaaaactttcaacaacggatctcttggttctggcatcgatgaagaacgcagctcgatgaagaacgcagccccctccccacgggtgggaacat

SEQ ID NO: 1426 - DNA, 258 bp, Fusarium sp.
cactcccaacccatgtgaacttatctctttgttgcctcggcgcaagctacccgggacctcgcgccccgggcggcccgccggcggacaaaccaaactctgttatcttagttgattatctgagtgtcttatttaataagtcaaaactttcaacaacggatctcttggttctggcatcgatgaagaacgcagcaaatcattacagaattatccaactcccaaacccatgtgaacttttctttttgttgcctcggcgcaagc

SEQ ID NO: 1427 - DNA, 236 bp, Gibellulopsis nigrescens
atactcataaccctttgtgaccttcatacctgttgcttcggcggcgcgcctctcggggcgtgcccgccggcattatcagaatctctgttcgaacccgacgatacttctgagtgttctaagcgaactgttaaaactttcaacaacggatctcttggctccagcatcgatgaagaacgcagcaaatgaggggtactactctcacccccctttggcctcttcccacttgttgcttcggc

SEQ ID NO: 1428 - DNA, 243 bp, Gnomoniopsis sp.
cgggtgctacccagaaaccctttgtgaattattctcattgttgcctcggcattgactggcctcttctggaggtcccttttccttcggggaaaggagcaggtcggccggtggccctataaactctttgtttttacagtgtatcttctgagtaaacaactataaatgaatcaaaacttttaacaacggatctcttggttctggcatcgatgaagaacgcagcaatggaacaaacgccctccgggg

SEQ ID NO: 1429 - DNA, 251 bp, Lewia infectoria
gcgggctggacacccccagccgggcactgcttcacggcgtgcgcggctgggccggccctgctgaattattcacccgtgtcttttgcgtacttcttgtttcctgggtgggctcgcccgccatcaggaccaaccacaaaccttttgcaatagcaatcacggtcagtaacaacgtaattaattacaactttcaacaacggatctcttggttctggcatcgatgaagaacgtagcgaaatgcgatacgtagtgtg

SEQ ID NO: 1430 - DNA, 210 bp, Mycosphaerella coffeicola
aagtcgtactggcttcgggctcgacctccaccctttgtgaacacaacttgttgcttcgggggcgaccctgccgtttcgacggcgagcgcccccggaggccttcaaacactgcatctttgcgtcggagtttaagtaaattaaacaaaactttcaacaacggatctcttggttctggcatcgatgaagaacgcagcggtctgcacacatcag

SEQ ID NO: 1431 - DNA, 213 bp, Mycosphaerellaceae sp.
gaccacggccggccgcgccagcgataatcctttgtgccccgacattgttgcctgccttttgaccctgccttggggcgggggctccgggtggacacttaaactcttgcgtaactttgcagtctgagtaaacttaattaataaattaaaacttttaacaccggatctcttggttctggcatcgatgacaaaacgcaacaaacgcagcagttaacc

SEQ ID NO: 1432 - DNA, 227 bp, Nigrospora oryzae
ctcccaacccatgtgaacttatctctttgttgcctcggcgcaagctacccgggacctcgcgccccgggcggcccgccggcggacaaaccaaactctgttatcttcgttgattatctgagtgtcttatttaataagtcaaaactttcaacaacggatctcttggttctggcatcgatgaagaacgcagcaaaaaacgcagcattatcccactcccaaacccgtgggaa

SEQ ID NO: 1433 - DNA, 216 bp, Nigrospora sp.
cccatgtgaacatatctctttgttgcctcggcgcaagctacccgggacctcgcgccccgggcggcccgccggcggacaaaccaaactctgttatcttcgttgattatctgagtgtcttatttaataagtcaaaactttcaacaacggatctcttggttctggcatcgatgaagaacgcagcagaaacgctcagccaactcccagacccgtgtgaag

SEQ ID NO: 1434 - DNA, 249 bp, Nigrospora sphaerica
actcccaaacccatgtgaacatatctctttgttgcctcggcgcaagctacccgggacctcgcgccccgggcggcccgccggcggacaaaccaaactctgttatcttcgttgattatctgagtgtcttatttaataagtcaaaactttcaacaacggatctcttggttctggcatcgatgaagaacgcagcaaaaaaaaaaatattccactccccaagccgggggggaaaatttttttttttttttttgg

SEQ ID NO: 1435 - DNA, 223 bp, Paecilomyces sp.
aatgcggactcccaaaccactgtgaacatacccgtaccgttgcctcggcgggcggccccagggcggggccgcagcctccccagcggaggcgcccgccgcaggtcgcaaaactataactatatttagtggcatctctgagtaacttccaaacaatcaaaactttcaacaacggatctcttggttctggcatcgatgaagaacgcagccaatacagaacttcgcg

SEQ ID NO: 1436 - DNA, 205 bp, Penicillium citrinum
aagtacgtgaacggggcaaacctcccacccgtgttgcccgaacctatgttgcctcggcgggccccgcgcccgccgacggcccccctgaacgctgtctgaagttgcagtctgagacctataacgaaattagttaaaactttcaacaacggatctcttggttccggcatcgatgaagaacgcagcatctggcatcggctgcaattcg

SEQ ID NO: 1437 - DNA, 213 bp, Retroconis sp.
gctatcccaaccattgtgaacctacctacaaccgttgcttcggcgggcggccccgggtctccccgggcgcccctccggcccctcgcgggggcccgccggaggtacgcaaccctctgtatttgcatggcctctctgagtctctgtactgaataagtcaaaactttcaacaacggatctcttggttctggcatcgatgaagaacgcagcagctac

SEQ ID NO: 1438 - DNA, 253 bp, Rhizopycnis sp.
gaaatattgggggtaagtttacgcttaaccaaaccgttccgtaggtgaacctgcggaaggatcattatcgatttcggtttacaccgttttctacctttgtctatgcgtaccacacgttccctcggggggcttggcccccactaggaccaaacataaacctttggtaatggcaatcggggtctgaaataatttaattattacaactttaaacaacggatctctgggttctggcatcggtaaaaaaacacaggaa

SEQ ID NO: 1439 - DNA, 210 bp, Schizothecium inaequale
tgcaactcccaaccattgtgaacctacctcaccgttgcctcggcgggtggcccccacccgggccgcgccggccccaccgggccggcaacccgtcagaggaccgcaactcttagtcatcattggcctctctgagtaacttatacaataagtcaaaactttcaacaacggatctcttggttctggcatcgatgaagaacgcagcaagtctaa

SEQ ID NO: 1440 - DNA, 237 bp, Stagonospora sp.
ctagctactggcatggggactgttagtctgcatggtatcactaccgatgagcagcaggtcccctgtctatacccttgttttttgcgtacctattgtttcctcggcgggcttgctcgccggctggacaaaatctataacctttttttaatcttcaatcagcgtctgaaattatacataataattacaactttcaacaacggatctcttggttctggcatcgatgaaaaacgcagccaa

SEQ ID NO: 1441 - DNA, 223 bp, Stemphylium lancipes
aaatgtggcgccctttggtattccaaagggcatgcctgttcgagcgtcatttgtaccctcaagctttgcttggtgttgggcgtctttgtctctcacgagactcgccttaaaatgattggcagccgacctactggtttcggagcgcagcacaattcttgcactttgaatcagccttggttgagcatccatcaagaccacatttttttaactttttaccgtacta

SEQ ID NO: 1442 - DNA, 209 bp, Thielavia hyrcaniae
ctaaaccattgtgaacctaccttctaccgttgcttcggcgggcgggccccagcgccccccccggccccccgcgggcgcccgccggaggatacccaaactcttgacattagtggcctctctgagtattctttactgaataagtcaaaactttcaacaacggatctcttggttctggcatcgatgaagaacgcagcaatttacagagttgc

SEQ ID NO: 1443 - DNA, 252 bp, Thielavia sp.
aaccattgtgacgttaccttcaaaccgttgcttcggcgggcggcccgggtccgcccggtgccccctggccccctcgcggggcgcccgccggaggaaacccaactcttgatacattatggcctctctgagtcttctgtactgaataagtcaaaactttcaacaacggatctcttggttctggcatcgatgaagaacgcagcgaaatgcgataagtaatgtgaattgcagaattcagtgaatcatcgaatcttt

SEQ ID NO: 1444 - DNA, 217 bp, Ulocladium chartarum
tgaagcgggctggcatccttcggggttacagccttgctgaattattcacccgtgtcttttgcgtacttcttgtttccttggtgggttcgcccaccataggacaaaccataaaccttttgtaattgcaatcagcgtcagtaaaaaaattaataattacaacttttaacaacggatctcttggttctggcatcgatgaagaacgcagccacttacaaaa

SEQ ID NO: 1445 - DNA, 219 bp, Verticillium sp.
gtacacgatactcataaccctttgtgaaccttcatacctgttgcttcggcggcgcgcctctcggggcgtgcccgccggcattatcagaatctctgttcgaacccgacgatacttctgagtgttctaagcgaactgttaaaactttcaacaacggatctcttggctccagcatcgatgaagaacgcagcaaggatcaatgaatttctcaccacccaagta

SEQ ID NO: 1446 - DNA, 1377 bp, Burkholderia caledonica
tagcaatcctggtggcgagtggcgaacgggtgagtaatacatcggaacgtgtcctgtagtgggggatagcccggcgaaagccggattaataccgcatacgatctgtggatgaaagcgggggatccttcgggacctcgcgctacaggggcggccgatggcagattagctagttggtggggtaaaggcctaccaaggcgacgatctgtagctggtctgagaggacgaccagccacactgggactgagacacggcccagactcctacgggaggcagcagtggggaattttggacaatgggcgaaagcctgatcccagcaatgccgcgtgtgtgaagaaggccttcgggttgtaaagcacttttgtccggaaagaaaacctcgtggttaatacccgtgggggatgacggtaccggaagaataagcaccggctaactacgtgccagcagccgcggtaatacgtagggtgcaagcgttaatcggaattactgggcgtaaagcgtgcgcaggcggtccgctaagacagatgtgaaatccccgggcttaacctgggaactgcatttgtgactggcgggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtatggaacctggctgagaggtccgggtgcccgaaagggagccataacacagggtgctgcatggctgtcgtcagctcgtgtcgtgagatgttgggataagtcccgcaacgagcgcaacccttgtccctagttgctacgcaagagcactctagggagactgccggtgacaaaccggaggaaggtggggatgacgtcaagtcctcatggcccttatgggtagggcttcacacgtcatacaatggtcggaacagagggtcgccaacccgcgagggggagccaatcccagaaaaccgatcgtagtccggatcgcactctgcaactcgagtgcgtgaagctggaatcgctagtaatcgcggatcagcatgccgcggtgaatacgttcccgggtcttgtacacaccgcccgtcacaccatgggagtgggttttaccagaagtggctagtctaaccgcaaggaggacg

SEQ ID NO: 1447 - DNA, 785 bp, Microbacterium binotii
tgcagtcgaacggtgaagcagagcttgctctgtggatcagtggcgaacgggtgagtaacacgtgagcaacctgccctggactctgggataagcgctggaaacggcgtctaatactggatacgagacgtggccgcatggtcaacgtttggaaagattttttggttcaggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagcaaggaagaagcgaaagtgacggtacttgcagaaaaagcgccggctaactacgtgccagcagccgcggtaatacgtagggcgcaagcgttatccggaattattgggcgtaaagagctcgtaggcggtttgtcgcgtctgctgtgaaaactggaggctcaacctccagcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggaccattccacggtttccgtgacgcagc

SEQ ID NO: 1448 - DNA, 1433 bp, Bacillus sp.
tatacatgcagtcgagcgaactgattagaagcttgcttctatgacgttagcggcggacgggtgagtaacacgtgggcaacctgcctgtaagactgggataacttcgggaaaccgaagctaataccggataggatcttctccttcatgggagatgattgaaagatggtttcggctatcacttacagatgggcccgcggtgcattagctagttggtgaggtaacggctcaccaaggcaacgatgcatagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtacgagagtaactgcttgtaccttgacggtacctaacccagaaagccacggctaactacgtgccagcagccgcggtaatacgtaggtggcaagcgttatcccggaattattgggcgtaaagcgcgcgcaggcggtttcttaagtctgatgtgaaagcccacggctcaaccgtggagggtcattggaaactggggaacttgagtgcagaagagaaaagcggaattccacgtgtagcggtgaaatgcgtagagatgtggaggaacaccagtggcgaaggcggctttttggtctgtaactgacgctgaggcgcgaaagcgtggggagcaaacaggattagataccctggtagtccacgccgtaaacgatgagtgctaagtgttagagggtttccgccctttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccagggtcttgacatcctctgacaactctagagatagagcgttccccttcgggggacagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatggtacaaagggctgcaagaccgcgaggtcaagccaatcccataaaaccattctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggagtaaccgtaaggagctagccgcctaaa

SEQ ID NO: 1449 - DNA, 19 bp, Artificial Sequence
  source: /note="Description of Artificial Sequence: Synthetic PCR primer V4_515F"
gtgccagcmgccgcggtaa

SEQ ID NO: 1450 - DNA, 20 bp, Artificial Sequence
  source: /note="Description of Artificial Sequence: Synthetic PCR primer V4_806R"
ggactachvgggtwtctaat

SEQ ID NO: 1451 - DNA, 20 bp, Artificial Sequence
  source: /note="Description of Artificial Sequence: Synthetic PCR primer 27F"
agagtttgatcctggctcag

SEQ ID NO: 1452 - DNA, 19 bp, Artificial Sequence
  source: /note="Description of Artificial Sequence: Synthetic PCR primer 1492R"
ggttaccttgttacgactt

SEQ ID NO: 1453 - DNA, 19 bp, Artificial Sequence
  source: /note="Description of Artificial Sequence: Synthetic PCR primer ITS1"
tccgtaggtgaacctgcgg

SEQ ID NO: 1454 - DNA, 20 bp, Artificial Sequence
  source: /note="Description of Artificial Sequence: Synthetic PCR primer ITS2"
gctgcgttcttcatcgatgc

SEQ ID NO: 1455 - DNA, 21 bp, Artificial Sequence
  source: /note="Description of Artificial Sequence: Synthetic PCR primer SR1R"
tacctggttgattctgccagt

SEQ ID NO: 1456 - DNA, 17 bp, Artificial Sequence
  source: /note="Description of Artificial Sequence: Synthetic PCR primer SR6"
tgttacgacttttactt

SEQ ID NO: 1457 - DNA, 22 bp, Artificial Sequence
  source: /note="Description of Artificial Sequence: Synthetic PCR primer ITS1F"
cttggtcatttagaggaagtaa

SEQ ID NO: 1458 - DNA, 20 bp, Artificial Sequence
  source: /note="Description of Artificial Sequence: Synthetic PCR primer ITS4"
tcctccgcttattgatatgc

SEQ ID NO: 1459 - DNA, 22 bp, Artificial Sequence
  source: /note="Description of Artificial Sequence: Synthetic PCR primer ITS1F"
cttggtcatttagaggaagtaa

SEQ ID NO: 1460 - DNA, 20 bp, Artificial Sequence
  source: /note="Description of Artificial Sequence: Synthetic PCR primer ITS4"
tcctccgcttattgatatgc

SEQ ID NO: 1461 - DNA, 22 bp, Artificial Sequence
  source: /note="Description of Artificial Sequence: Synthetic PCR primer ITS5"
ggaagtaaaagtcgtaacaagg

SEQ ID NO: 1462 - DNA, 23 bp, Artificial Sequence
  source: /note="Description of Artificial Sequence: Synthetic PCR primer ITS4A"
cgttactrrggcaatccctgttg

SEQ ID NO: 1463 - DNA, 18 bp, Artificial Sequence
  source: /note="Description of Artificial Sequence: Synthetic PCR primer ITS4Basidio"
gcrcggaaracgcttctc

SEQ ID NO: 1464 - DNA, 20 bp, Artificial Sequence
  source: /note="Description of Artificial Sequence: Synthetic PCR primer ITS4Chytrid"
ttttcccgtttcattcgcca

SEQ ID NO: 1465 - DNA, 17 bp, Artificial Sequence
  source: /note="Description of Artificial Sequence: Synthetic PCR primer ITS4Oo"
atagactacaattcgcc

SEQ ID NO: 1466 - DNA, 16 bp, Artificial Sequence
  source: /note="Description of Artificial Sequence: Synthetic PCR primer ITS4Zygo"
aaaacgtwtcttcaaa

SEQ ID NO: 1467 - DNA, 18 bp, Artificial Sequence
  source: /note="Description of Artificial Sequence: Synthetic PCR primer Arch 340F"
ccctayggggygcascag

SEQ ID NO: 1468 - DNA, 18 bp, Artificial Sequence
  source: /note="Description of Artificial Sequence: Synthetic PCR primer Arch 1000R"
gagargwrgtgcatggcc

SEQ ID NO: 1469 - DNA, 20 bp, Artificial Sequence
  source: /note="Description of Artificial Sequence: Synthetic PCR primer 27F Degen"
agrrttygatymtggytyag

SEQ ID NO: 1470 - DNA, 19 bp, Artificial Sequence
  source: /note="Description of Artificial Sequence: Synthetic PCR primer 799F"
aacmggattagataccckg

SEQ ID NO: 1471 - DNA, 20 bp, Artificial Sequence
  source: /note="Description of Artificial Sequence: Synthetic PCR primer 27F Degen"
hgghtaccttgttacgactt

What is claimed is:

1. A method for preparing an agricultural seed preparation, comprising:
    a) manually or mechanically inoculating a plurality of Glycine agricultural plant seeds with a formulation comprising a purified bacterial population at a concentration of at least $10^4$ CFU/ml in a liquid formulation or at least $10^4$ CFU/gm in a non-liquid formulation, the bacterial population comprising a seed bacterial endophyte comprising a 16S nucleic acid sequence comprising SEQ ID NO: 1446 and exhibiting the ability to produce or induce in a Glycine agricultural plant grown from the inoculated Glycine agricultural plant seed at least one of production of an auxin or production of acetoin, wherein the inoculated seeds and/or the Glycine agricultural plant grown therefrom comprises an increased production of a polypeptide of Aspartate aminotransferase glyoxysomal isozyme AAT1 precursor, wherein the seed bacterial endophyte is present in the formulation in an amount capable of providing a benefit to the inoculated Glycine plant seeds or to the Glycine agricultural plants grown from the inoculated Glycine plant seeds compared to reference Glycine seeds or reference Glycine agricultural plants, wherein the formulation further comprises a stabilizer, a fungicide, a preservative, or a combination thereof; and
    (b) packaging the inoculated seeds in a container.

2. The method of claim 1, wherein the bacterial endophyte is amplified within a tissue of the Glycine agricultural plant.

3. The method of claim 1, wherein the inoculated seeds are packaged in the container such that they are substantially stable at about 25 degrees C. for at least 7 days.

4. The method of claim 1, wherein the bacterial endophyte comprises the ability to induce in the Glycine agricultural plant production of an auxin and production of acetoin.

5. The method of claim 1, wherein the inoculating in (a) comprises spraying, immersing, coating, encapsulating, injecting or dusting the seeds with the formulation.

6. The method of claim 1, wherein the purified bacterial population comprises a plurality of seed bacterial endophyte entities.

7. The method of claim 1, wherein the inoculating results in a concentration of at least $10^4$ CFU of the bacterial endophyte on the surface of the seed.

8. The method of claim 1, wherein the bacterial population is obtained from an interior seed compartment and/or wherein the bacterial population comprises a seed bacterial endophyte.

9. The method of claim 1, wherein the bacterial population is obtained from a plant species other than the seeds to which the formulation is contacted.

10. The method of claim 1, wherein the bacterial population is obtained from a plant species other than the seeds to which the formulation is contacted, and wherein the bacterial population is propagated in culture.

11. The method of claim 1, wherein the bacterial population is obtained from a plant cultivar or a seed thereof different from the cultivar of the seeds to which the formulation is contacted.

12. The method of claim 1, wherein the bacterial population is obtained from a surface sterilized seed.

13. The method of claim 1, wherein the benefit is increased tolerance to drought.

14. An agricultural seed preparation prepared by the method of claim 1.

15. A method of making a seed treatment, the method comprising:
   (a) inoculating an isolated cultured bacterial endophyte cell or spore comprising a 16S nucleic acid sequence comprising SEQ ID NO: 1446 into a liquid medium;
   (b) culturing the bacterial endophyte cell or spore in the medium at a temperature of about 4 to about 37 degrees C. until the cell or spore density in the medium is at least $10^4$ CFU/mL; and
   (c) collecting the vegetative cells or spores under conditions suitable to produce a seed treatment.

* * * * *